United States Patent
Sheppard et al.

(10) Patent No.: US 6,822,082 B2
(45) Date of Patent: Nov. 23, 2004

(54) POLYNUCLEOTIDES FOR MAMMALIAN SECRETED PROTEIN, Z1055G2P

(75) Inventors: Paul O. Sheppard, Granite Falls, WA (US); Scott R. Presnell, Tacoma, WA (US)

(73) Assignee: ZymoGenetics, Inc., Seattle, WA (US)

( * ) Notice: Subject to any disclaimer, the term of this patent is extended or adjusted under 35 U.S.C. 154(b) by 0 days.

(21) Appl. No.: 09/893,737

(22) Filed: Jun. 28, 2001

(65) Prior Publication Data

US 2002/0110855 A1 Aug. 15, 2002

Related U.S. Application Data

(60) Provisional application No. 60/215,446, filed on Jun. 30, 2000.

(51) Int. Cl.[7] .............................................. C07H 21/00

(52) U.S. Cl. .................... 536/23.1; 435/320.1; 435/325

(58) Field of Search ....................... 536/23.1; 435/320.1, 435/325

(56) References Cited

U.S. PATENT DOCUMENTS 6,068,976 A * 5/2000 Briggs et al. .................. 435/6

OTHER PUBLICATIONS

Gerhold et al., It's the genes! EST access to human genome content. 1996, BioEssays, vol. 18, No. 12, pp. 973–998.*

Wells et al., The chemokine information source: identification and characterization of novel chemokines using the WorldWideWeb and Expressed Sequence Tag Databases. 1997, Journal of Leukocyte Biology, vol. 61, No. 5, pp. 545–550.*

Russell et al., Structural Features can be Unconserved in Proteins with Similar Folds. 1994, Journal of Molecular Biology, vol. 244, pp. 332–350.*

Lopez et al., Whole–genome sequence annotation: 'Going wrong with confidence.' 1999, Molecular Microbiology, vol. 32, pp. 881–891.*

Attwood, The Babel of Bioinformatics. 2000, Science, vol. 290, No. 5491, pp. 471–473.*

* cited by examiner

*Primary Examiner*—Ardin H. Marschel
*Assistant Examiner*—Carolyn L. Smith
(74) *Attorney, Agent, or Firm*—Robyn Adams

(57) ABSTRACT

The present invention provides to polynucleotides and secreted proteins encoded by the polynucleotides. The proteins include a variety of fusion proteins, including fusions comprising a signal peptide selected from the group consisting of signal peptides shown in SEQ ID NO:M, wherein M is an even integer from 2 to 328, operably linked to a second polypeptide. The invention further provides therapeutic and diagnostic methods utilizing the polynucleotides, polypeptides, and antagonists of the polypeptides.

6 Claims, No Drawings

POLYNUCLEOTIDES FOR MAMMALIAN SECRETED PROTEIN, Z1055G2P

This application is related to Provisional Application No. 60/215,446 filed on Jun. 30, 2000. Under 35 U.S.C. § 119(e)(1), this application claims benefit of said Provisional Application.

BACKGROUND OF THE INVENTION

Within the field of genetic engineering, polynucleotides encoding proteins of interest have been identified and cloned by methods that require a detailed knowledge of the structure and/or function of the polynucleotide or the encoded protein. These methods include hybridization screening, polymerase chain reaction (PCR), and expression cloning.

With the more recent advent of large DNA sequence databases and the accompanying data analysis tools, identification of genes of interest is possible through the analysis of raw sequence data. Databases can be "mined" to locate sequences that resemble (are "homologous to") sequences of known function. Alignment of similar sequences can be used to place novel sequences within families of structurally similar sequences. These analytical tools can be combined with structural information obtained from, for example, X-ray crystallography to predict the higher order structure of a novel polypeptide. These analyses also facilitate prediction of polypeptide function. These recent technological advances have greatly increased the pace of gene discovery.

Genetic engineering has made available a number of genes and proteins of pharmaceutical or other economic importance. Such proteins include, for example, tissue plasminogen activator (t-PA) (U.S. Pat. No. 4,766,075), coagulation factor VII (U.S. Pat. No. 4,784,950), erythropoietin (U.S. Pat. No. 4,703,008), platelet derived growth factor (U.S. Pat. No. 4,889,919), and various industrial enzymes (e.g., U.S. Pat. Nos. 5,965,384; 5,942,431; and 5,922,586).

Although estimates vary as to the amount of the human genome that has been identified to date, there remains a need in the art for further characterization of the human genome and the proteins encoded thereby. Previously unknown genes and proteins will be useful in the treatment and/or prevention of many human diseases, included diseases that have heretofore been refractory to treatment.

SUMMARY OF THE INVENTION

Within one aspect of the invention there is provided an isolated polypeptide comprising fifteen contiguous amino acid residues of a polypeptide as shown in SEQ ID NO:M, wherein M is an even integer from 2 to 328. Within one embodiment, the isolated polypeptide is from 15 to 723 amino acid residues in length. Within another embodiment, the at least fifteen contiguous amino acid residues of SEQ ID NO:M are operably linked via a peptide bond or polypeptide linker to a second polypeptide selected from the group consisting of maltose binding protein, an immunoglobulin constant region, a polyhistidine tag, and a peptide as shown in SEQ ID NO:123. Within another embodiment, the polypeptide comprises at least 30 contiguous residues of SEQ ID NO:M. Within a further embodiment, the polypeptide comprises at least 47 contiguous residues of SEQ ID NO:M.

Within a second aspect of the invention there is provided an isolated, mature protein encoded by a sequence selected from the group consisting of SEQ ID NO:N, wherein N is an odd integer from 1 to 327.

A third aspect of the invention provides isolated polynucleotides encoding the polypeptides disclosed above.

Within certain embodiments of the invention the polynucleotides comprise a sequence of nucleotides as shown in SEQ ID NO:N, wherein N is an odd integer from 1 to 327.

Within a fourth aspect of the invention there is provided an expression vector comprising the following operably linked elements: a transcription promoter; a DNA segment encoding a polypeptide as shown in SEQ ID NO:M, wherein M is an even integer from 2 to 328; and a transcription terminator.

A fifth aspect of the invention provides a cultured cell comprising the expression vector disclosed above. The cultured cell can be used, inter alia, within a method of producing a polypeptide, the method comprising (a) culturing the cell under conditions whereby the sequence of nucleotides is expressed, and (b) recovering the polypeptide. The invention also provides a polypeptide produced by this method.

Within a sixth aspect of the ivention there is provided an isolated polynucleotide encoding a fusion protein, wherein the fusion protein comprises a secretory peptide selected from the group consisting of secretory peptides shown in SEQ ID NO:M, wherein M is an even integer from 2 to 328, operably linked to a second polypeptide.

Within a seventh aspect of the invention there is provided an expression vector comprising the following operably linked elements: a transcription promoter; a DNA segment encoding a fusion protein as disclosed above; and a transcription terminator. The invention further provides a cultured cell comprising this expression vector, wherein the cell expresses the DNA segment and produces the encoded fusion protein. Also provided is a method of producing a protein comprising culturing the cell under conditions whereby the DNA segment is expressed, and recovering the second polypeptide. Within one embodiment the recovered second polypeptide is joined to a portion of a protein of SEQ ID NO: M, wherein M is an even integer from 2 to 328.

Within a further aspect of the invention there is provided a computer-readable medium encoded with a data structure comprising SEQ ID NO:X, wherein X is an integer from 1 to 328.

Within an additional aspect of the invention there is provided an antibody that specifically binds to a protein selected from of the group consisting of SEQ ID NO:M, wherein Ml is an even integer from 2 to 328.

Within an additional aspect, the invention provides an isolated polypeptide comprising fourteen contiguous amino acid residues of a polypeptide as shown in SEQ If) NO:M, wherein M is an even integer from 2 to 328. Within an embodiment, said isolated polypeptide comprising said isolated fourteen contiguous amino acid residues is selected from the polypeptides as shown in Table 1. Within another embodiment, said fourteen contiguous amino acid residues can be used in a fusion protein to facilitate the secretion of a second polypeptide of interest outside a cell.

Within an additional aspect the invention provides a method of detecting protein secretion from a cell or tissue comprising detecting a mature MSP selected from the group consisting of SEQ ID NO:M, wherein M is an even integer from 2 to 328 in conditioned media or membrane extracts.

These and other aspects of the invention will become evident upon reference to the following detailed description of the invention.

DETAILED DESCRIPTION OF THE INVENTION

Prior to setting forth the invention in detail, it may be helpful to the understanding thereof to define the following terms:

The term "affinity tag" is used herein to denote a polypeptide segment that can be attached to a second polypeptide to provide for purification of the second polypeptide or provide sites for attachment of the second polypeptide to a substrate. In principal, any peptide or protein for which an antibody or other specific binding agent is available can be used as an affinity tag. Affinity tags include a poly-histidine tract, protein A (Nilsson et al., *EMBO J.* 4:1075, 1985; Nilsson et al., *Methods Enzymol.* 198:3, 1991), glutathione S transferase (Smith and Johnson, *Gene* 67:31, 1988), Glu-Glu affinity tag (Grussenmeyer et al., *Proc. Natl. Acad. Sci. USA* 82:7952–7954, 1985; see SEQ ID NO:123), substance P, Flag™ peptide (Hopp et al., *Biotechnology* 6:1204–1210, 1988), maltose binding protein (Kellerman and Ferenci, *Methods Enzymol.* 90:459–463, 1982; Guan et al., *Gene* 67:21–30, 1987), streptavidin binding peptide, thioredoxin, ubiquitin, cellulose binding protein, T7 polymerase, immunoglobulin constant domain, or other antigenic epitope or binding domain. See, in general, Ford et al., *Protein Expression and Purification* 2: 95–107, 1991. Affinity tags can be used individually or in combination. DNAs encoding affinity tags and other reagents are available from commercial suppliers (e.g., Pharmacia Biotech, Piscataway, N.J.; Eastman Kodak, New Haven, Conn.; New England Biolabs, Beverly, Mass.).

The term "allelic variant" is used herein to denote any of two or more alternative forms of a gene occupying the same chromosomal locus. Allelic variation arises naturally through mutation, and may result in phenotypic polymorphism within populations. Gene mutations can be silent (no change in the encoded polypeptide) or may encode polypeptides having altered amino acid sequence. The term allelic variant is also used herein to denote a protein encoded by an allelic variant of a gene.

The terms "amino-terminal" and "carboxyl-terminal" are used herein to denote positions within polypeptides. Where the context allows, these terms are used with reference to a particular sequence or portion of a polypeptide to denote proximity or relative position. For example, a certain sequence positioned carboxyl-terminal to a reference sequence within a polypeptide is located proximal to the carboxyl terminus of the reference sequence, but is not necessarily at the carboxyl terminus of the complete polypeptide.

A "complement" of a polynucleotide molecule is a polynucleotide molecule having a complementary base sequence and reverse orientation as compared to a reference sequence. For example, the sequence 5' ATGCACGGG 3' is complementary to 5' CCCGTGCAT 3'.

"Corresponding to", when used in reference to a nucleotide or amino acid sequence, indicates the position in a second sequence that aligns with the reference position when two sequences are optimally aligned.

The term "degenerate nucleotide sequence" denotes a sequence of nucleotides that includes one or more degenerate codons (as compared to a reference polynucleotide molecule that encodes a polypeptide). Degenerate codons encompass different triplets of nucleotides, but encode the same amino acid residue (i.e., GAU and GAC triplets each encode Asp).

The term "expression vector" is used to denote a DNA molecule, linear or circular, that comprises a segment encoding a polypeptide of interest operably linked to additional segments that provide for its transcription, wherein said segments are arranged in a way that does not exist naturally. Such additional segments include promoter and terminator sequences, and may also include one or more origins of replication, one or more selectable markers, an enhancer, a polyadenylation signal, etc. Expression vectors are generally derived from plasmid or viral DNA, or may contain elements of both.

The term "isolated", when applied to a polynucleotide, denotes that the polynucleotide has been removed from its natural genetic milieu and is thus free of other extraneous or unwanted coding sequences, and is in a form suitable for use within genetically engineered protein production systems. Such isolated molecules are those that are separated from their natural environment and include cDNA and genomic clones. Isolated DNA molecules of the present invention are free of other genes with which they are ordinarily associated, but may include naturally occurring 5' and 3' untranslated regions such as promoters and terminators The identification of associated regions will be evident to one of ordinary skill in the art (see for example, Dynan and Tijan, *Nature* 316:774–78, 1985).

An "isolated" polypeptide or protein is a polypeptide or protein that is found in a condition other than its native environment, such as apart from blood and animal tissue. In a preferred form, the isolated polypeptide or protein is substantially free of other polypeptides or proteins, particularly other polypeptides or proteins of animal origin. It is preferred to provide the polypeptides or proteins in a highly purified form, i.e. greater than 95% pure, more preferably greater than 99% pure. When used in this context, the term "isolated" does not exclude the presence of the same polypeptide or protein in alternative physical forms, such as dimers or alternatively glycosylated or derivatized forms.

A "mature protein" is a protein that is produced by cellular processing of a primary translation product of a DNA sequence. Such processing may include removal of a secretory signal peptide, sometimes in combination with a propeptide. Mature sequences can be predicted from full-length sequences using methods known in the art for predicting cleavage sites. See, for example, von Heijne (*Nuc. Acids Res.* 14:4683, 1986). The sequence of a mature protein can be determined experimentally by expressing a DNA sequence of interest in a eukaryotic host cell and determining the amino acid sequence of the final product. For proteins lacking secretory peptides, the primary translation product will be the mature protein.

"Operably linked", when referring to DNA segments, indicates that the segments are arranged so that they function in concert for their intended purposes, e.g., transcription initiates in the promoter and proceeds through the coding segment to the terminator. When referring to polypeptides, "operably linked" includes both covalently (e.g., by disulfide bonding) and non-covalently (e.g., by hydrogen bonding, hydrophobic interactions, or salt-bridge interactions) linked sequences, wherein the desired function(s) of the sequences are retained.

The term "ortholog" denotes a polypeptide or protein obtained from one species that is the functional counterpart of a polypeptide or protein from a different species. Sequence differences among orthologs are the result of speciation.

"Paralogs" are distinct but structurally related proteins made by an organism. Paralogs are believed to arise through gene duplication. For example, (α-globin, β-globin, and myoglobin are paralogs of each other.

A "polynucleotide" is a single- or double-stranded polymer of deoxyribonucleotide or ribonucleotide bases read from the 5' to the 3' end. Polynucleotides include RNA and DNA, and may be isolated from natural sources, synthesized in vitro, or prepared from a combination of natural and synthetic molecules. Sizes of polynucleotides are expressed as base pairs (abbreviated "bp"), nucleotides ("nt"), or kilobases ("kb"). Where the context allows, the latter two terms may describe polynucleotides that are single-stranded or double-stranded. When the term is applied to double-stranded molecules it is used to denote overall length and will be understood to be equivalent to the term "base pairs". It will be recognized by those skilled in the art that the two strands of a double-stranded polynucleotide may differ slightly in length and that the ends thereof may be staggered as a result of enzymatic cleavage; thus all nucleotides within a double-stranded polynucleotide molecule may not be paired. Such unpaired ends will in general not exceed 20 nt in length.

A "polypeptide" is a polymer of amino acid residues joined by peptide bonds, whether produced naturally or synthetically. Polypeptides of less than about 10 amino acid residues are commonly referred to as "peptides".

The term "promoter" is used herein for its art-recognized meaning to denote a portion of a gene containing DNA sequences that provide for the binding of RNA polymerase and initiation of transcription. Promoter sequences are commonly, but not always, found in the 5' non-coding regions of genes.

A "protein" is a macromolecule comprising one or more polypeptide chains. A protein may also comprise non-peptidic components, such as carbohydrate groups. Carbohydrates and other non-peptidic substituents may be added to a protein by the cell in which the protein is produced, and will vary with the type of cell. Proteins are defined herein in terms of their amino acid backbone structures; substituents such as carbohydrate groups are generally not specified, but may be present nonetheless.

A "secretory signal sequence" is a DNA sequence that encodes a polypeptide (a "secretory peptide") that, as a component of a larger polypeptide, directs the larger polypeptide through a secretory pathway of a cell in which it is synthesized. The larger polypeptide is commonly cleaved to remove the secretory peptide during transit through the secretory pathway.

All references cited herein are incorporated by reference in their entirety.

The present invention is based in part upon the discovery of a group of novel, protein-enoding DNA molecules, designated "MSP" proteins, polypeptides and polynucleotides. These DNA molecules and the amino acid sequences that they encode are shown in SEQ ID NO:1 through SEQ ID NO:328. Sequence analysis predicts that each of the encoded proteins includes an amino-terminal secretory peptide. These secretory peptides are shown below in Table 1, wherein residue numbers are in reference to the indicated SEQ ID NO. As will be understood by those skilled in the art, the cleavage sites predicted by conventional models of secretory peptide cleavage (e.g., if von Heijne, *Nuc. Acids Res.* 14:4683, 1986) are not always exact and may vary by as much as ±5 residues. In addition, cleavage may occur at multiple sites within 5 residues of the indicated position. The mature form of any given protein may thus consists of a plurality of species differing at their amino termini.

TABLE 1

| Protein | SEQ ID NO: | Residues 1- |
|---|---|---|
| Z1055G2P | 2 | 21 |
| Z1183G7P | 4 | 32 |
| Z125G9P | 6 | 17 |
| Z128G9P | 8 | 22 |
| Z1297G2P | 10 | 20 |
| Z1345G3P | 12 | 19 |
| Z1345G5P | 14 | 40 |
| Z1659G4P | 16 | 26 |
| Z2007G2P | 18 | 15 |
| Z2263G5P | 20 | 19 |
| Z25829G3P | 22 | 43 |
| Z25999G1P | 24 | 19 |
| Z27842G1P | 26 | 19 |
| Z2812G3P | 28 | 36 |
| Z281G1P | 30 | 45 |
| Z2839G2P | 32 | 48 |
| Z287G9P | 34 | 46 |
| Z2887G7P | 36 | 29 |
| Z2972G5P | 38 | 30 |
| Z297G1P | 40 | 38 |
| Z3038G1P | 42 | 25 |
| Z321375G1P | 44 | 36 |
| Z3264G1P | 46 | 14 |
| Z3357G2P | 48 | 16 |
| Z4256G1P | 50 | 17 |
| Z4384G2P | 52 | 17 |
| Z446500G1P | 54 | 19 |
| Z4622G1P | 56 | 22 |
| Z4670G1P | 58 | 31 |
| Z555G20P | 60 | 16 |
| Z577G9P | 62 | 20 |
| Z700497G2P | 64 | 25 |
| Z700823G2P | 66 | 31 |
| Z700996G11P | 68 | 23 |
| Z701935G4P | 70 | 36 |
| Z702408G2P | 72 | 20 |
| Z74922G1P | 74 | 21 |
| Z790708G1P | 76 | 34 |
| Z791735G1P | 78 | 19 |
| Z792987G7P | 80 | 28 |
| Z793561G4P | 82 | 16 |
| Z794249G2P | 84 | 20 |
| Z799543G2P | 86 | 14 |
| Z807106G2P | 88 | 22 |
| Z807166G2P | 90 | 15 |
| Z807270G7P | 92 | 15 |
| Z807340G6P | 94 | 28 |
| Z807941G1P | 96 | 31 |
| Z809241G11P | 98 | 14 |
| Z809335G4P | 100 | 21 |
| Z809469G10P | 102 | 22 |
| Z835361G1P | 104 | 32 |
| Z835510G5P | 106 | 20 |
| Z835548G2P | 108 | 32 |
| Z835840G8P | 110 | 18 |
| Z835892G6P | 112 | 26 |
| Z835944G6P | 114 | 21 |
| Z835999G1P | 116 | 14 |
| Z836222G4P | 118 | 16 |
| Z836250G2P | 120 | 17 |
| Z836307G1P | 122 | 15 |
| Z836325G9P | 124 | 17 |
| Z836355G5P | 126 | 22 |
| Z837892G2P | 128 | 33 |
| Z838027G3P | 130 | 28 |
| Z838054G2P | 132 | 16 |
| Z838468G2P | 134 | 33 |
| Z842039G5P | 136 | 18 |
| Z842046G1P | 138 | 50 |
| Z846090G4P | 140 | 21 |
| Z846280G2P | 142 | 27 |
| Z846300G9P | 144 | 23 |
| Z846363G2P | 146 | 33 |
| Z846626G9P | 148 | 24 |
| Z846631G3P | 150 | 15 |
| Z849065G4P | 152 | 25 |
| Z849135G16P | 154 | 40 |

TABLE 1-continued

| Protein | SEQ ID NO: | Residues 1- |
|---|---|---|
| Z849162G4P | 156 | 14 |
| Z849213G14P | 158 | 14 |
| Z849221G9P | 160 | 20 |
| Z849314G5P | 162 | 23 |
| Z849377G7P | 164 | 18 |
| Z849533G7P | 166 | 21 |
| Z849559G5P | 168 | 22 |
| Z849746G1P | 170 | 19 |
| Z849893G9P | 172 | 16 |
| Z855073G14P | 174 | 21 |
| Z855260G4P | 176 | 15 |
| Z869105G16P | 178 | 14 |
| Z869173G14P | 180 | 20 |
| Z869333G11P | 182 | 21 |
| Z869654G5P | 184 | 30 |
| Z869671G3P | 186 | 15 |
| Z869719G6P | 188 | 16 |
| Z873630G11P | 190 | 16 |
| Z873683G5P | 192 | 30 |
| Z873717G10P | 194 | 22 |
| Z873745G3P | 196 | 31 |
| Z873811G8P | 198 | 31 |
| Z873818G10P | 200 | 26 |
| Z874015G4P | 202 | 35 |
| Z874090G3P | 204 | 20 |
| Z874090G4P | 206 | 20 |
| Z874178G8P | 208 | 18 |
| Z874193G6P | 210 | 26 |
| Z875409G1P | 212 | 14 |
| Z877091G9P | 214 | 24 |
| Z877300G8P | 216 | 33 |
| Z877532G7P | 218 | 17 |
| Z877574G3P | 220 | 41 |
| Z877975G4P | 222 | 41 |
| Z887014G7P | 224 | 18 |
| Z887031G1P | 226 | 18 |
| Z887042G3P | 228 | 25 |
| Z887280G5P | 230 | 22 |
| Z887300G2P | 232 | 27 |
| Z888627G9P | 234 | 24 |
| Z888644G7P | 236 | 21 |
| Z888879G3P | 238 | 16 |
| Z890990G20P | 240 | 21 |
| Z891399G5P | 242 | 18 |
| Z891519G8P | 244 | 23 |
| Z891532G2P | 246 | 14 |
| Z891575G17P | 248 | 15 |
| Z891639G1P | 250 | 40 |
| Z891682G2P | 252 | 20 |
| Z891886G1P | 254 | 18 |
| Z892025G7P | 256 | 34 |
| Z892026G1P | 258 | 14 |
| Z903906G4P | 260 | 25 |
| Z908203G11P | 262 | 16 |
| Z908225G14P | 264 | 31 |
| Z908460G2P | 266 | 24 |
| Z908463G2P | 268 | 19 |
| Z908593G16P | 270 | 18 |
| Z908644G15P | 272 | 20 |
| Z908655G7P | 274 | 14 |
| Z908668G10P | 276 | 18 |
| Z908874G13P | 278 | 23 |
| Z908957G1P | 280 | 15 |
| Z909165G15P | 282 | 38 |
| Z909204G1P | 284 | 22 |
| Z909337G10P | 286 | 29 |
| Z909460G4P | 288 | 17 |
| Z910197G6P | 290 | 18 |
| Z912187G1P | 292 | 24 |
| Z913549G1P | 294 | 42 |
| Z930005G2P | 296 | 19 |
| Z930582G14P | 298 | 25 |
| Z930757G12P | 300 | 27 |
| Z930798G6P | 302 | 25 |
| Z930857G2P | 304 | 30 |
| Z930898G2P | 306 | 20 |
| Z931019G10P | 308 | 17 |

TABLE 1-continued

| Protein | SEQ ID NO: | Residues 1- |
|---|---|---|
| Z931276G1P | 310 | 15 |
| Z931363G4P | 312 | 23 |
| Z931654G1P | 314 | 18 |
| Z931828G2P | 316 | 18 |
| Z931874G4P | 318 | 29 |
| Z935148G9P | 320 | 21 |
| Z935205G2P | 322 | 24 |
| Z935414G4P | 324 | 18 |
| Z935553G3P | 326 | 26 |
| Z935805G4P | 328 | 33 |

A secretory peptide of a protein of the present invention can be used to direct the secretion of other proteins of interest from a host cell. Thus, the present invention provides, inter alia, fusions comprising such a secretory peptide of a protein disclosed herein operably linked to another protein of interest. The secretory peptide can be used to direct the secretion of other proteins of interest by joining a polynucleotide sequence encoding it, in the correct reading frame, to the 5' end of a sequence encoding the other protein of interest. Those skilled in the art will recognize that the resulting fused sequence may encode additional residues of a protein of the present invention at the amino terminus of the protein to be secreted. In the extreme case, the fusion may comprise an entire protein of the present invention fused to the amino terminus of a second protein, whereby secretion of the fusion protein is directed by the secretory peptide of the protein of the present invention. It will often be desirable to include a proteolytic cleavage site between the protein of the present invention (or portion thereof) and the other protein of interest. The joined polynucleotide sequences are then introduced into a host cell, which is cultured according to conventional methods. The protein of interest is then recovered from the culture media. Methods for introducing DNA into host cells, culturing the cells, and isolating recombinant proteins are known in the art. Representative methods are summarized below.

Higher order structures of the proteins of the present invention can be predicted by computer analysis using available software (e.g., the Insight II® viewer and homology modeling tools available from MSI, San Diego, Calif.; and King and Sternberg, *Protein Sci.* 5:2298–310, 1996). In addition, analytical algorithms permit the identification of homologies between newly discovered proteins and known proteins. Such homologies are indicative of related biological functions.

Table 2 lists proteins described herein which have regions of similarity with other known proteins.

TABLE 2

| PROTEIN | DESCRIPTION |
|---|---|
| Z1345G5P | SDC4_Human |
| Z2839G2P | Retrovirus unknown protein U5/1 |
| Z2887G7P | PIR_T19298 *Caenorhabditis elegans*: |
| Z321375G1P | AK019752 *Mus musculus* adult male testis cDNA |
| Z807270G7P | U93565_1 Human L1 element L1.12 putative p150 gene |
| Z809241G11P | ALU1_Human ALU Subfamily J Sequence |
| Z835548G2P | AF026465_1 *Mus musculus* putative neuronal cell adhesion UH |
| Z835840G8P | FMOD_Human Fibromodulin |
| Z835944G6P | ID U93566_1 Human L1 element |
| Z838054G2P | SYT5_Human (membrane) |

TABLE 2-continued

| PROTEIN | DESCRIPTION |
|---|---|
| Z846363G2P | AK026318_1 Homo sapiens cDNA: FLJ22665 fis, HSIL8RB1 Human interleukin-8 receptor |
| Z849162G4P | PSP_G00866 Human secreted protein |
| Z869671G3P | PIR_T43481 probable mucin DKFZ |
| Z877574G3P | OTX1_Human Homebox Protein OTX1 |
| Z887300G2P | PSP_B07469 A human leucine-rich repeat protein |
| Z891519G8P | PIR_T38548 hypothetical zinc-finger protein |
| Z891886G1P | ER72_Human protein disulfide isomerase-related protein ERP-72 precursor |
| Z931874G4P | PIR_T19299 hypothetical protein C15A7.3 - Caenorhabditis elegans |
| Z935414G4P | MANB_BOVIN beta-mannosidase precursor |

Table 3 lists proteins described herein which have regions of identity with other known proteins.

TABLE 3

| PROTEIN | DESCRIPTION |
|---|---|
| Z701935G4P | X86096_1 H. sapiens mRNA for E2F-4 protein |
| Z792987G7P | AB041736 Homo sapiens mRNA for SEZ6L |
| Z794249G2P | AL121756_2 Human DNA sequence from clone RP4-726C3 |
| Z809469G10P | AB007925_1 Homo sapiens mRNA for KIAA045 |
| Z835361G1P | BC005138 Homo sapiens, BUB3 |
| Z835944G6P | U93566_1 Human L1 element |
| Z846300G9P | Human colon cancer cell line polynucleotide sequence |
| Z849065G4P | Polypeptide from WO200078961.50 |
| Z849221G9P | AF253318_1 Homo sapiens GFR receptor alpha 4 protein |
| Z849314G5P | CLDI_Human |
| Z873630G11P | AB033072_1 Homo sapiens mRNA for KIAA1246 protein |
| Z887031G1P | AF119664_1 Homo sapiens transcriptional regulator |
| Z891639G1P | AK025362_1 Homo sapiens cDNA: FLJ21709 fis |
| Z903906G4P | M12987_6 F Plasmid DNA complete mini-F region |
| Z908203G11P | Human signal peptide containing protein HSPP-1 |
| Z908874G13P | CLDI_Human Claudin-18 |
| Z909337G10P | AR080331 Sequence 1 from U.S. Pat. No. 5968768 |
| Z930857G2P | Human prostacyclin-stimulating factor-2 |

A protein of the present invention can be prepared as a fusion protein by joining it to a second polypeptide or a plurality of additional polypeptides. Suitable second polypeptides include amino- or carboxyl-terminal extensions, such as linker peptides of up to about 20–25 residues and extensions that facilitate purification (affinity tags) as disclosed above. A protein of interest can be prepared as a fusion to a dimerizing protein as disclosed in U.S. Pat. Nos. 5,155,027 and 5,567,584. Preferred dimerizing proteins in this regard include immunoglobulin constant region domains. Immunoglobulin-polypeptide fusions can be expressed in genetically engineered cells to produce a variety of multimeric analogs of a protein of interest. Fusion proteins can also comprise auxiliary domains that target the protein of interest to specific cells, tissues, or macromolecules (e.g., collagen). For example, a protein of interest can be targeted to a predetermined cell type by fusing it to a ligand that specifically binds to a receptor on the surface of a target cell. In this way, proteins can be targeted for therapeutic or diagnostic purposes. A protein can be fused to two or more moieties, such as an affinity tag for purification and a targeting domain. Protein fusions can also comprise one or more cleavage sites, particularly between domains. See, Tuan et al., Connective Tissue Research 34:1–9, 1996. Proteins of the present invention can also be used as targeting moieties within fusion proteins comprising, for example, cytokines, cytotoxins, or other biologically active polypeptide moieties.

Protein fusions of the present invention will usually contain not more than about 1,200 amino acid residues joined to the MSP protein. For example, an MSP protein can be fused to E. coli β-galactosidase (1,021 residues; see Casadaban et al., J. Bacteriol. 143:971–980, 1980), a 10-residue spacer, and a 4-residue factor Xa cleavage site. Such a protein comprising, for example, MSPZ809335G4P (SEQ ID NO:100), contains 723 amino acid residues. In a second example, an MSP protein can be fused to maltose binding protein (approximately 370 residues), a 4-residue cleavage site, and a 6-residue polyhistidine tag.

As disclosed above, the proteins of the present invention or portions thereof can also be used to direct the secretion of a second protein. When such fusions are designed so that the secreted protein retains a portion of the protein of the present invention, the fusion protein can be purified by means that exploit the properties of the protein of the present invention. Typical of such methods is immunoaffinity chromatography using an antibody directed against a protein of the present invention. When such a fusion is engineered to contain a cleavage site at the fusion point, the fusion can be cleaved and the protein of interest recovered free of extraneous sequence.

As secreted proteins, MSP can be useful to monitor secretion of proteins in general from cells or tissue. In doing so, cell lines or tissues shown to express the proteins of the present invention can be monitored to detect for example if the cell or tissue has a defective secretory pathway. Thus, cell membrane extracts or conditioned media from the cell or tissue can be tested for the presence or absence of the mature MSP protein. Similarly, when trying to identify if a recombinantly expressed protein is has a functional signal peptide, the molecules of the present invention can be used as a positive control.

The present invention also provides polynucleotide molecules, including DNA and RNA molecules, that encode the proteins disclosed above. Those skilled in the art will readily recognize that, in view of the degeneracy of the genetic code, considerable sequence variation is possible among these polynucleotide molecules. The amino acid sequence information provided herein can be used by one of ordinary skill in the art to generate degenerate sequences comprising all nucleotide sequences encoding a particular polypeptide. Table 4 sets forth the one-letter codes used to denote degenerate nucleotide positions. "Resolutions" are the nucleotides denoted by a code letter. "Complement" indicates the code for the complementary nucleotide(s). For example, the code Y denotes either C or T, and its complement R denotes A or G, A being complementary to T, and G being complementary to C.

TABLE 4

| Nucleotide | Resolutions | Complement | Resolutions |
|---|---|---|---|
| A | A | T | T |
| C | C | G | G |
| G | G | C | C |
| T | T | A | A |
| R | A\|G | Y | C\|T |
| Y | C\|T | R | A\|G |
| M | A\|C | K | G\|T |
| K | G\|T | M | A\|C |
| S | C\|G | S | C\|G |
| W | A\|T | W | A\|T |
| H | A\|C\|T | D | A\|G\|T |
| B | C\|G\|T | V | A\|C\|G |

TABLE 4-continued

| Nucleotide | Resolutions | Complement | Resolutions |
|---|---|---|---|
| V | A\|C\|G | B | C\|G\|T |
| D | A\|G\|T | H | A\|C\|T |
| N | A\|C\|G\|T | N | A\|C\|G\|T |

Degenerate codons encompassing all possible codons for a given amino acid are set forth in Table 5, below.

TABLE 5

| Amino Acid | One-Letter Code | Codons | | | | | | Degenerate Codon |
|---|---|---|---|---|---|---|---|---|
| Cys | C | TGC | TGT | | | | | TGY |
| Ser | S | AGC | AGT | TCA | TCC | TCG | TCT | WSN |
| Thr | T | ACA | ACC | ACG | ACT | | | CAN |
| Pro | P | CCA | CCC | CCG | CCT | | | CCN |
| Ala | A | GCA | GCC | GCG | GCT | | | GCN |
| Gly | G | GGA | GGC | GGG | GGT | | | GGN |
| Asn | N | AAC | AAT | | | | | AAY |
| Asp | D | GAC | GAT | | | | | GAY |
| Glu | E | GAA | GAG | | | | | GAR |
| Gln | Q | CAA | CAG | | | | | CAR |
| His | H | CAC | CAT | | | | | CAY |
| Arg | R | AGA | AGG | CGA | CGC | CGG | CGT | MGN |
| Lys | K | AAA | AAG | | | | | AAR |
| Met | M | ATG | | | | | | ATG |
| Ile | I | ATA | ATC | ATT | | | | ATH |
| Leu | L | CTA | CTC | CTG | CTT | TTA | TTG | YTN |
| Val | V | GTA | GTC | GTG | GTT | | | GTN |
| Phe | F | TTC | TTT | | | | | TTY |
| Tyr | Y | TAC | TAT | | | | | TAY |
| Trp | W | TGG | | | | | | TGG |
| Ter | . | TAA | TAG | TGA | | | | TRR |
| Asn\|Asp | B | | | | | | | RAY |
| Glu\|Gln | Z | | | | | | | SAR |
| Any | X | | | | | | | NNN |
| Gap | — | | | | | | | — |

One of ordinary skill in the art will appreciate that some ambiguity is introduced in determining a degenerate codon, representative of all possible codons encoding each amino acid. For example, the degenerate codon for serine (WSN) can, in some circumstances, encode arginine (AGR), and the degenerate codon for arginine (MGN) can, in some circumstances, encode serine (AGY). A similar relationship exists between codons encoding phenylalanine and leucine. Thus, some polynucleotides encompassed by the degenerate sequences may encode variant amino acid sequences, but one of ordinary skill in the art can easily identify such variant sequences by reference to the amino acid sequences disclosed in the accompanying Sequence Listing.

Methods for preparing DNA and RNA are well known in the art. Complementary DNA (cDNA) clones are prepared from RNA that is isolated from a tissue or cell that produces large amounts of the cognate mRNA. Such tissues and cells are identified by methods commonly known in the art, such as Northern blotting (Thomas, *Proc. Natl. Acad. Sci. USA* 77:5201, 1980). Databases of expressed sequence tags (ESTs) can be analyzed to produce an "electronic Northern" wherein sequences are assigned to specific cell or tissue sources on the basis of their abundance within libraries.

A panel of cDNAs from human tissues can be screened for tissue expression using PCR. As an example, such a panel can made from commercially available first strand cDNA (Clontech laboratories, Inc., Palo Alto Calif.) and would contain 20 first-strand cDNA samples from the human tissues shown in Table 6. The panel can be set up in a 96-well format that further included a human genomic DNA (obtained from Clontech Laboratories, Inc.) positive control sample and a water-only well as a negative control sample. Each well can contain approximately 0.2–100 pg/µl of cDNA, diluted with water to 17.5 µl. The PCR reactions are set up by adding oligonucleotide primers, DNA polymerase (Ex Taq™; TAKARA Shuzo Co. Ltd. Biomedicals Group, Japan or Advantage™ 2 cDNA polymerase mix; Clontech Laboratories, Inc.) with the appropriate supplied buffer, dNTP mix (TAKARA Shuzo Co. Ltd.), and a density increasing agent and tracking dye (RediLoad; Research Genetics, Inc., Huntsville, Ala.) to each sample on the panel. The amplification of the cDNA can be carried out as follows: incubation at 94° C. for 2 minutes; 35 cycles of 94° C. for 30 seconds, 60° C. for 20 seconds, and 72° C. for 30 seconds; followed by incubation at 72° C. for 5 minutes. A portion of the PCR reaction product is then subjected to standard agarose gel electrophoresis using a 4% agarose gel. The results of a PCR that was set up in this manner is shown in Table 6.

TABLE 6

| Protein | 1 | 2 | 3 | 4 | 5 | 6 | 7 | 8 | 9 | 10 | 11 | 12 | 13 | 14 | 15 | 16 | 17 | 18 | 19 | 20 | 21 | 22 |
|---|---|---|---|---|---|---|---|---|---|---|---|---|---|---|---|---|---|---|---|---|---|---|
| Z909460G4P | n | n | n | n | n | n | n | n | n | n | n | n | n | n | | n | n | n | n | | | y |
| Z931828G2p | n | n | y | y | y | y | y | n | y | n | n | y | y | n | y | n | n | n | n | y | n | y |
| Z1055G2P | n | n | n | y | n | n | y | n | n | y | y | y | y | n | y | y | y | y | y | y | n | y |
| Z1183G7P | y | y | y | n | y | y | n | y | n | n | n | n | n | n | n | n | n | y | n | y | n | y |
| Z1345G3P | y | n | y | n | n | y | n | n | n | y | n | y | n | y | n | y | y | y | y | y | n | y |
| Z1659G4P | n | y | y | n | y | y | n | n | n | n | n | n | n | n | n | n | n | n | y | n | n | y |
| Z2007G2P | y | y | y | y | y | y | y | y | y | y | y | y | y | y | y | y | y | y | y | y | n | y |
| Z25999G1P | n | n | n | n | n | n | n | n | n | n | n | n | n | n | n | n | n | n | n | n | n | y |
| Z281G1P | n | n | n | n | n | n | n | n | n | n | n | n | n | n | n | n | n | n | n | n | n | n |
| Z4622G1P | y | y | y | n | y | y | n | n | y | y | y | y | y | | y | y | y | y | y | y | n | y |
| Z4670G1P | n | n | n | y | n | y | n | n | y | y | y | n | y | n | y | n | y | y | y | y | n | y |
| Z555G20P | n | n | n | n | n | n | n | n | n | n | n | n | n | n | n | n | n | n | n | n | n | y |
| Z577G9P | y | n | y | n | y | y | n | n | y | n | y | y | y | y | n | y | y | y | y | y | n | y |
| Z702408G2P | n | n | n | y | nd | nd | n | n | n | n | n | n | n | n | n | n | n | n | n | n | nd | n |
| Z74922G1P | n | n | n | n | n | n | n | n | n | n | n | n | n | n | n | n | n | n | n | n | n | y |
| Z793561G4P | n | n | n | n | n | n | n | n | y | n | y | n | y | nd | n | y | n | y | y | n | n | y |
| Z799543G2P | n | n | y | n | y | n | n | n | y | n | y | n | y | nd | n | y | y | y | n | y | n | y |
| Z807166G2P | n | n | n | n | n | n | n | n | n | n | n | n | n | nd | n | n | n | n | n | n | n | y |
| Z835892G6P | n | n | n | n | n | n | n | n | n | n | n | n | n | nd | n | y | n | n | n | n | n | y |
| Z836222G4P | n | n | n | n | n | n | n | n | n | n | n | n | n | n | n | n | n | n | n | n | n | n |
| Z836355G5P | n | n | n | n | n | n | n | n | n | n | n | n | n | n | n | n | n | n | n | n | n | n |

TABLE 6-continued

| Protein | 1 | 2 | 3 | 4 | 5 | 6 | 7 | 8 | 9 | 10 | 11 | 12 | 13 | 14 | 15 | 16 | 17 | 18 | 19 | 20 | 21 | 22 |
|---|---|---|---|---|---|---|---|---|---|---|---|---|---|---|---|---|---|---|---|---|---|---|
| Z837892G2P | n | n | n | n | n | n | n | n | n | n | n | n | n | n | nd | n | n | n | n | n | n | y |
| Z842046G1P | n | n | n | n | n | n | n | n | n | n | n | n | n | n | n | n | n | n | n | n | n | y |
| Z846626G9P | n | n | n | n | n | n | n | n | n | n | n | n | n | n | nd | n | n | n | n | n | n | y |
| Z846631G3P | n | n | n | n | n | n | n | n | n | n | n | n | n | n | n | n | n | n | n | n | n | n |
| Z849213G14P | n | n | n | n | n | n | n | n | n | n | n | n | n | n | n | n | n | n | n | n | n | n |
| Z849746G1P | y | n | n | n | n | n | n | n | n | n | y | y | n | nd | n | n | n | n | n | y | N | y |
| Z855260G4P | n | n | n | n | n | n | n | n | n | n | n | n | n | n | n | n | n | n | n | n | N | y |
| Z869173G14P | n | n | n | n | n | n | n | n | n | n | n | n | n | n | nd | n | n | n | n | n | N | y |
| Z869719G6P | n | y | y | y | y | y | n | n | n | y | y | y | n | y | y | y | n | y | y | y | N | y |
| Z873745G3P | n | n | n | n | nn | n | n | n | n | n | n | n | n | n | y | n | n | n | y | n | N | y |
| Z874178G8P | y | nd | n | n | n | y | n | n | n | n | n | n | n | n | y | n | n | n | n | n | N | y |
| Z874193G6P | n | n | n | n | n | n | n | n | n | n | n | n | n | n | y | n | n | n | n | n | N | y |
| Z875409G1P | n | n | y | n | nd | n | n | n | n | n | n | n | n | n | n | n | n | y | n | n | N | nd |
| Z877091G9P | n | n | n | n | y | n | n | y | n | n | y | n | y | y | n | n | n | n | n | n | N | y |
| Z877300G8P | n | n | n | n | n | n | n | n | n | n | n | n | n | n | y | n | n | n | n | n | N | y |
| Z877532G7P | n | n | n | n | n | n | n | n | n | n | n | n | n | n | n | n | n | n | n | n | N | y |
| Z887014G7P | n | n | n | y | n | n | n | n | y | n | n | n | n | n | y | n | n | n | n | n | N | y |
| Z887280G5P | n | n | y | y | n | n | n | n | n | nd | y | y | n | y | y | y | y | y | y | n | N | y |
| Z888627G9P | n | n | n | n | n | y | n | n | y | n | y | n | y | n | y | n | n | n | n | n | N | y |
| Z888644G7P | y | y | y | y | y | y | y | n | n | y | n | y | n | y | y | y | n | n | y | nd | N | y |
| Z888879G3P | n | n | n | n | n | n | n | n | n | n | n | n | n | n | n | n | n | n | n | n | N | n |
| Z890990G20P | n | n | n | n | n | n | n | n | n | n | n | n | n | n | n | n | n | n | n | n | n | y |
| Z891399G5P | n | n | n | n | n | n | n | n | n | n | n | n | n | n | n | n | n | n | n | n | n | n |
| Z891682G2P | n | n | y | n | y | y | n | n | y | y | y | y | y | y | y | y | y | y | y | y | n | y |
| Z908225G14P | n | n | n | n | n | n | n | n | n | n | n | n | n | n | n | n | n | n | n | n | n | y |
| Z908460G2P | n | n | n | n | y | y | n | n | n | y | n | n | n | n | y | n | n | n | n | n | n | y |
| Z908593G16P | n | n | n | n | n | n | n | n | n | n | n | n | n | n | n | n | n | n | n | n | n | n |
| Z908655G7P | n | n | n | n | n | n | n | n | n | n | n | n | n | n | n | n | n | n | n | n | n | y |
| Z909165G15P | n | n | n | n | n | n | n | n | n | n | n | n | n | n | n | n | n | n | n | n | n | n |
| Z909204G1P | n | n | n | n | y | n | n | n | n | n | n | n | n | n | n | n | n | n | n | n | n | y |
| Z910197G6P | n | n | n | n | n | n | n | n | n | n | n | n | n | n | n | n | n | n | n | n | n | y |
| Z912187G1P | y | n | n | n | n | n | n | n | n | n | n | n | n | n | n | n | n | n | n | n | n | y |
| Z930005G2P | n | n | n | n | n | n | n | n | n | n | n | n | n | n | n | n | y | y | y | n | n | y |
| Z930798G6P | n | n | n | n | n | n | n | n | n | n | n | n | n | n | n | n | n | n | n | n | n | y |
| Z931019G10P | n | n | n | n | n | n | n | n | n | n | n | n | n | n | n | n | n | n | n | n | n | y |
| Z931654G1P | n | n | n | n | n | n | n | n | n | n | n | n | n | n | n | n | n | n | n | n | n | y |
| Z935553G3P | n | n | n | n | n | n | n | n | n | n | n | n | n | n | n | n | n | n | n | n | n | y |
| Z125G9P | n | n | n | n | n | n | n | n | n | n | n | n | n | n | n | n | n | n | y | n | n | y |
| Z25829GP3 | n | n | n | n | n | n | n | n | n | n | n | y | n | n | n | n | n | n | n | n | n | y |
| Z27842G1P | n | n | n | n | n | n | n | n | n | n | n | n | n | n | n | n | n | n | n | n | n | y |
| Z287G9P | n | n | n | n | n | n | n | n | n | n | n | n | n | n | n | n | n | n | n | n | n | y |
| Z2972G5P | n | n | y | n | n | n | n | n | n | n | n | n | n | n | n | n | n | n | n | n | n | y |
| Z3038G1P | n | n | n | n | n | n | n | n | n | n | n | n | n | n | n | n | n | n | n | n | n | y |
| Z3264G1P | n | n | n | n | n | n | n | n | n | n | n | n | n | n | n | n | n | n | n | n | n | y |
| Z700497G2P | n | n | n | n | n | n | n | n | n | n | n | n | n | n | nd | n | n | n | n | n | n | y |
| Z700823G2P | n | n | n | n | n | n | n | n | n | n | n | n | n | n | n | n | n | n | n | n | n | y |
| Z809335G4P | y | y | y | y | y | y | y | n | n | y | y | y | n | y | y | y | n | n | y | n | n | y |
| Z835999G1P | n | n | n | n | n | n | n | n | n | n | n | n | n | n | n | n | n | n | n | n | n | n |
| Z836325G9P | n | n | n | n | n | n | n | n | n | n | n | n | n | n | n | n | n | n | n | n | n | y |
| Z838468G2P | n | n | n | n | n | n | n | n | n | n | n | n | n | n | n | n | n | n | n | n | n | n |
| Z846090G4P | y | y | y | nd | nd | y | y | n | n | n | n | y | n | n | y | n | n | n | n | n | n | n |
| Z846280G2P | n | n | n | n | n | n | n | n | N | n | n | n | n | n | n | n | n | n | n | n | n | y |
| Z849135G16P | n | n | n | n | n | n | n | n | N | n | n | n | n | n | n | n | n | n | n | n | n | y |
| Z869654G5P | n | n | n | n | n | y | n | n | N | n | n | n | n | n | n | n | n | n | n | n | n | y |
| Z874090G3P | n | n | n | n | n | n | n | n | N | n | n | n | n | n | n | n | n | n | n | n | n | y |
| Z891575G17P | y | y | y | y | y | y | y | y | N | n | n | y | n | y | y | y | n | y | n | y | n | y |
| Z892025G7P | nd | nd | nd | nd | nd | nd | nd | nd | nd | nd | nd | nd | nd | nd | nd | nd | nd | nd | nd | nd | nd | nd |
| Z892026G1P | n | n | n | n | y | n | n | n | N | n | n | y | n | n | n | n | n | n | n | n | n | n |
| Z908644G15P | nd | nd | nd | nd | nd | nd | nd | nd | nd | nd | nd | nd | nd | nd | nd | nd | nd | nd | nd | nd | nd | nd |
| Z930898G2P | n | n | n | n | n | n | n | n | N | n | n | n | y | n | n | n | n | n | n | n | n | y |
| Z931363G4P | n | n | n | n | n | n | n | n | N | n | n | n | n | n | n | n | n | n | n | n | n | y |
| Z874015G4P | nd | nd | nd | nd | nd | nd | nd | nd | nd | nd | nd | nd | nd | nd | nd | nd | nd | nd | nd | nd | nd | nd |
| Z935148G9P | n | n | n | n | y | n | n | n | Y | n | n | n | n | n | n | n | n | n | y | n | n | y |
| Z935205G2P | n | n | n | n | n | n | n | n | Y | n | y | n | y | n | n | n | y | y | y | y | n | y |
| Z4256G1P | n | n | n | n | n | n | n | n | N | n | n | n | n | n | n | n | n | n | n | n | n | y |
| Z849559G5P | n | n | n | n | n | n | n | n | n | n | n | n | n | n | n | n | n | n | n | n | n | y |
| Z855073G14P | n | n | n | n | y | n | n | y | y | n | n | y | n | n | n | n | n | n | n | n | n | y |

Tissues screened were: 1, brain; 2, heart; 3, kidney; 4, liver; 5, lung; 6, pancreas; 7, placenta; 8, skeletal muscle; 9, colon; 10, ovary; 11, peripheral blood leukocytes; 12, prostate; 13, small intestine; 14, spleen; 15, testis; 16, thymus; 17, bone marrow; 18, fetal liver; 19, lymph node; 20, tonsil; 21, H$_2$O; 22, genomic DNA. Y = yes; n = no; nd = not determined.

Total RNA can be prepared using guanidine HCl extraction followed by isolation by centrifugation in a CsCl gradient (Chirgwin et al., *Biochemistry* 18:52–94, 1979). Poly (A)$^+$ RNA is prepared from total RNA using the method of Aviv and Leder (*Proc. Natl. Acad. Sci. USA* 69:1408–1412, 1972). Complementary DNA (cDNA) is prepared from poly(A)$^+$ RNA using known methods. In the alternative, genomic DNA can be isolated. For some applications (e.g., expression in transgenic animals) it may be preferable to use a genomic clone, or to modify a cDNA clone to include at least one genomic intron. Methods for identifying and isolating cDNA and genomic clones are well known and within the level of ordinary skill in the art, and include the use of the sequences disclosed herein, sequences complementary thereto, or parts thereof, for probing or priming a library. Such methods include, for example, hybridization or polymerase chain reaction ("PCR", Mullis, U.S. Pat. No. 4,683,202). Expression libraries can be probed with antibodies to a protein of interest, receptor fragments, or other specific binding partners.

The polynucleotides of the present invention can also be prepared by automated synthesis. Synthesis of polynucleotides is within the level of ordinary skill in the art, and suitable equipment and reagents are available from commercial suppliers. See, in general, Glick and Pasternak, *Molecular Biotechnology, Principles & Applications of Recombinant DNA*, ASM Press, Washington, D.C., 1994; Itakura et al., *Ann. Rev. Biochem.* 53: 323–56, 1984; and Climie et al., *Proc. Natl. Acad. Sci. USA* 87:633–7, 1990.

The present invention further provides antisense polynucleotides that are complementary to a segment of a polynucleotide as set forth in one of SEQ ID NO:N, wherein N is an odd integer from 1 to 327. Such antisense polynucleotides are designed to bind to the corresponding mRNA and inhibit its translation. Antisense polynucleotides are used to inhibit gene expression in cell culture or in a patient, and can be used as probes or primers for research or diagnostic purposes.

Probes and primers of the present invention comprise a suitable fragment, and may comprise up to the complete sequence, of a polynucleotide as shown in SEQ ID NO:N or the complement thereof, wherein N is an odd integer from 1 to 327. Probes will generally be at least 20 nucleotides in length, although somewhat shorter probes (14–17 nucleotides) can be used. PCR primers are at least 5 nucleotides in length, preferably 15 or more nt, more preferably 20–30 nt. Shorter polynucleotide probes and primers are referred to in the art as "oligonucleotides," and can be DNA or RNA. Probes will generally comprise an oligonucleotide linked to a label, such as a radionuclide.

Probes and primers as disclosed herein can be used for cloning allelic, orthologous, and paralogous sequences. Allelic variants, of the disclosed sequences can be cloned by probing cDNA or genomic libraries from different individuals according to standard procedures. Orthologous sequences can be cloned using information and compositions provided by the present invention in combination with conventional cloning techniques. For example, a cDNA can be cloned using mRNA obtained from a tissue or cell type that expresses the protein. Suitable sources of mRNA can be identified by probing Northern blots with probes designed from the sequences disclosed herein. A library is then prepared from mRNA of a positive tissue or cell line. A cDNA can then be isolated by a variety of methods, such as by probing with a complete or partial human cDNA or with one or more sets of degenerate probes based on the disclosed sequences. A cDNA can also be cloned by PCR using primers designed from the sequences disclosed herein. Within an additional method, the cDNA library can be used to transform or transfect host cells, and expression of the cDNA of interest can be detected with an antibody to the encoded protein. Similar techniques can also be applied to the isolation of genomic clones. Orthologous and paralogous sequences can be identified from libraries by probing blots at low stringency and washing the blots at successively higher stringency until background is suitably reduced.

Probes and primers disclosed herein can be used to clone 5' non-coding regions of a corresponding gene. Such promoter elements can thus be used to direct the tissue-specific expression of heterologous genes in, for example, transgenic animals or patients treated with gene therapy. Cloning of 5' flanking sequences also facilitates production of a protein of interest by "gene activation" as disclosed in U.S. Pat. No. 5,641,670. Briefly, expression of an endogenous gene in a cell is altered by introducing into its locus a DNA construct comprising at least a targeting sequence, a regulatory sequence, an exon, and an unpaired splice donor site. The targeting sequence is a 5' non-coding sequence that permits homologous recombination of the construct with the endogenous locus, whereby the sequences within the construct become operably linked with the endogenous coding sequence. In this way, an endogenous promoter can be replaced or supplemented with other regulatory sequences to provide enhanced, tissue-specific, or otherwise regulated expression.

The polynucleotides of the present invention further include polynucleotides encoding the fusion proteins, including signal peptide fusions, disclosed above.

In studying cell biology it is useful to monitor changing levels of mRNA as a function of cell and tissue development. As a set of cDNA molecules, the polynucleotides of the present invention, for example SEQ ID NO:N, wherein N is an odd integer from 1 to 327, can also be used to screen for levels of mRNA of the polypeptides, i.e., as shown in SEQ ID NO:M, wherein M is an even integer from 2 to 328. Screening for message level fluctuations of the molecules of the present invention are useful for studying, for example, cell replication, activation, and quiescence.

The present invention further provides a computer-readable medium encoded with a data structure that provides at least one of SEQ ID NO:1 through SEQ ID NO:328. Suitable forms of computer-readable media include magnetic media and optically-readable media. Examples of magnetic media include a hard or fixed drive, a random access memory (RAM) chip, a floppy disk, digital linear tape (DLT), a disk cache, and a ZIP® disk. Optically readable media are exemplified by compact discs (e.g., CD-read only memory (ROM), CD-rewritable (RW), and CD-recordable), and digital versatile/video discs (DVD) (e.g., DVD-ROM, DVD-RAM, and DVD+RW).

The polypeptides of the present invention, including full-length proteins, biologically active fragments, immunogenic fragments, and fusion proteins, can be produced in genetically engineered host cells according to conventional techniques. Suitable host cells are those cell types that can be transformed or transfected with exogenous DNA and grown in culture, and include bacteria, fungal cells, and cultured higher eukaryotic cells. Eukaryotic cells, particularly cultured cells of multicellular organisms, are generally preferred for the production of proteins having higher eukaryotic-type post-translational modifications (e.g., γ-carboxylation) and for making proteins, especially secretory proteins, for pharmaceutical use in humans. Techniques for manipulating cloned DNA molecules and introducing exogenous DNA into a variety of host cells are disclosed by Sambrook et al., *Molecular Cloning: A Laboratory Manual*, 2nd ed., Cold Spring Harbor Laboratory Press, Cold Spring Harbor, N.Y., 1989, and Ausubel et al., eds., *Current Protocols in Molecular Biology*, Green and Wiley and Sons, N.Y., 1993.

In general, a DNA sequence encoding a polypeptide of interest is operably linked to other genetic elements required for its expression, generally including a transcription promoter and terminator, within an expression vector. The vector will also commonly contain one or more selectable markers and one or more origins of replication, although those skilled in the art will recognize that within certain systems selectable markers can be provided on separate vectors, and replication of the exogenous DNA can be achieved through integration into the host cell genome. Selection of promoters, terminators, selectable markers, vectors and other elements is a matter of routine design within the level of ordinary skill in the art. Many such elements are described in the literature and are available through commercial suppliers.

To direct a polypeptide into the secretory pathway of a host cell, a secretory signal sequence (also known as a leader sequence, prepro sequence or pre sequence) is provided in the expression vector. The secretory signal sequence may be that of the protein of interest, or may be derived from another secreted protein (e.g., t-PA; see U.S. Pat. No. 5,641,655) or synthesized (de novo. The secretory signal sequence is operably linked to the DNA sequence encoding the protein of interest, i.e., the two sequences are joined in the correct reading frame and positioned to direct the newly synthesized protein into the secretory pathway of the host cell. Secretory signal sequences are commonly positioned 5' to the DNA sequence encoding the protein of interest, although certain secretory signal sequences may be positioned elsewhere in the DNA sequence of interest (see, e.g., Welch et al., U.S. Pat. No. 5,037,743; Holland et al., U.S. Pat. No. 5,143,830).

Cultured mammalian cells are suitable hosts for use within the present invention. Methods for introducing exogenous DNA into mammalian host cells include calcium phosphate-mediated transfection (Wigler et al., *Cell* 14:725, 1978; Corsaro and Pearson, *Somatic Cell Genetics* 7:603, 1981: Graham and Van der Eb, *Virology* 52:456, 1973), electroporation (Neumann et al., *EMBO J.* 1:841–845, 1982), DEAE-dextran mediated transfection (Ausubel et al., ibid.), and liposome-mediated transfection (Hawley-Nelson et al., *Focus* 15:73, 1993; Ciccarone et al., *Focus* 15:80, 1993). The production of recombinant polypeptides in cultured mammalian cells is disclosed by, for example, Levinson et al., U.S. Pat. No. 4,713,339; Hagen et al., U.S. Pat. No. 4,784,950; Palmiter et al., U.S. Pat. No. 4,579,821; and Ringold, U.S. Pat. No. 4,656,134. Suitable cultured mammalian cells include the COS-1 (ATCC No. CRL 1650), COS-7 (ATCC No. CRL 1651), BHK (ATCC No. CRL 1632), BHK 570 (ATCC No. CRL 10314), 293 (ATCC No. CRL 1573; Graham et al., *J. Gen. Virol.* 36:59–72, 1977) and Chinese hamster ovary (e.g. CHO-K1; ATCC No. CCL 61) cell lines. Additional suitable cell lines are known in the art and available from public depositories such as the American Type Culture Collection, Manasas, Va. In general, strong transcription promoters are preferred, such as promoters from SV-40 or cytomegalovirus. See, e.g., U.S. Pat. No. 4,956,288. Other suitable promoters include those from metallothionein genes (U.S. Pat. Nos. 4,579,821 and 4,601, 978) and the adenovirus major late promoter. Within an alternative embodiment, adenovirus vectors can be employed. See, for example, Garnier et al., *Cytotechnol.* 15:145–55, 1994.

Drug selection is generally used to select for cultured mammalian cells into which foreign DNA has been inserted. Such cells are commonly referred to as "transfectants". Cells that have been cultured in the presence of the selective agent and are able to pass the gene of interest to their progeny are referred to as "stable transfectants." An exemplary selectable marker is a gene encoding resistance to the antibiotic neomycin. Selection is carried out in the presence of a neomycin-type drug, such as G-418 or the like. Selection systems can also be used to increase the expression level of the gene of interest, a process referred to as "amplification." Amplification is carried out by culturing transfectants in the presence of a low level of the selective agent and then increasing the amount of selective agent to select for cells that produce high levels of the products of the introduced genes. An exemplary amplifiable selectable marker is dihydrofolate reductase, which confers resistance to methotrexate. Other drug resistance genes (e.g. hygromycin resistance, multi-drug resistance, puromycin acetyltransferase) can also be used.

Insect cells can be infected with recombinant baculovirus, commonly derived from *Autographa californica* nuclear polyhedrosis virus (AcNPV). See, King and Possee, *The Baculovirus Expression System: A Laboratory Guide*, London, Chapman & Hall; O'Reilly et al., *Baculovirus Expression Vectors: A Laboratory Manual*, New York, Oxford University Press., 1994; and Richardson, Ed., *Baculovirus Expression Protocols. Methods in Molecular Biology.*, Humana Press, Totowa, N.J., 1995. Recombinant baculovirus can also be produced through the use of a transposon-based system described by Luckow et al. (*J. Virol.* 67:4566–4579, 1993). This system, which utilizes transfer vectors, is commercially available in kit form (Bac-to-Bac™ kit; Life Technologies, Rockville, Md.). See also, Hill-Perkins and Possee, *J. Gen. Virol.* 71:971–976, 1990; Bonning et al., *J. Gen. Virol.* 75:1551–1556, 1994; and Chazenbalk and Rapoport, *J. Biol. Chem.* 270:1543–1549, 1995.

For protein production, the recombinant virus is used to infect host cells, typically a cell line derived from the fall armyworm, *Spodoptera frugiperda* (e.g., Sf9 or Sf21 cells) or *Trichoplusia ni* (e.g., High Five™ cells; Invitrogen, Carlsbad, Calif.). See, in general, Glick and Pasternak, *Molecular Biotechnology: Principles and Applications of Recombinant DNA*, ASM Press, Washington, D.C., 1994. See also, U.S. Pat. No. 5,300,435. Serum-free media are used to grow and maintain the cells. Suitable media formulations are known in the art and can be obtained from commercial suppliers. The cells are grown up from an inoculation density of approximately $2–5\times10^5$ cells to a density of $1–2\times10^6$ cells, at which time a recombinant viral stock is added at a multiplicity of infection (MOI) of 0.1 to 10, more typically near 3. Procedures used are generally described in available laboratory manuals (e.g., King and Possee, ibid.; O'Reilly et al., ibid.; Richardson, ibid.). See also, Guarino et al., U.S. Pat. No. 5,162,222 and WIPO publication WO 94/064653.

Fungal cells, including yeast cells, can also be used within the present invention. Yeast species of particular interest in this regard include *Saccharomyces cerevisiae, Pichia pastoris*, and *Pichia methanolica*. Methods for transforming *S. cerevisiae* cells with exogenous DNA and producing recombinant polypeptides therefrom are disclosed by, for example, Kawasaki, U.S. Pat. No. 4,599,311; Kawasaki et al., U.S. Pat. No. 4,931,373; Brake, U.S. Pat. No. 4,870,008; Welch et al., U.S. Pat. No. 5,037,743; and Murray et al., U.S. Pat. No. 4,845,075. Transformed cells are selected by phenotype determined by the selectable marker, commonly drug resistance or the ability to grow in the absence of a particular nutrient (e.g., leucine). A preferred vector system for use in *Saccharomyces cerevisiae* is the POT1 vector system disclosed by Kawasaki et al. (U.S. Pat. No. 4,931,373), which allows transformed cells to be selected by growth in glucose-containing media. Suitable promoters and terminators for use in yeast include those from glycolytic enzyme genes (see, e.g., Kawasaki, U.S. Pat. No. 4,599,311; Kingsman et al., U.S. Pat. No. 4,615,974; and Bitter, U.S. Pat. No. 4,977,092) and alcohol dehydrogenase genes. See also U.S. Pat. Nos. 4,990,446; 5,063,154; 5,139,936 and 4,661,454.

Transformation systems for other yeasts, including *Hansenula polymorpha, Schizosaccharomyces pombe, Kluyveromyces lactis, Kluyveromyces fragilis, Ustilago maydis, Pichia pastoris, Pichia methanolica, Pichia guillermondii* and *Candida maltosa* are known in the art. See, for example, Gleeson et al., *J. Gen. Microbiol.* 132:3459–3465, 1986 and Cregg, U.S. Pat. No. 4,882,279. Aspergillus cells may be utilized according to the methods of McKnight et al., U.S. Pat. No. 4,935,349. Methods for transforming *Acremonium chrysogenum* are disclosed by Sumino et al., U.S. Pat. No. 5,162,228. Methods for transforming Neurospora are disclosed by Lambowitz, U.S. Pat. No. 4,486,533. Production of recombinant proteins in *Pichia methanolica* is disclosed in U.S. Patents No. 5,716,808, 5,736,383, 5,854,039, and 5,888,768; and WIPO publications WO 99/14347 and WO 99/14320.

Other higher eukaryotic cells, including plant cells and avian cells, can also be used as hosts according to methods commonly known in the art. For example, the use of *Agrobacterium rhizogenes* as a vector for expressing genes in plant cells has been reviewed by Sinkar et al., *J. Biosci. (Bangalore)* 11:47–58, 1987.

Prokaryotic host cells, including strains of the bacteria *Escherichia coli*, Bacillus and other genera are also useful host cells within the present invention. Techniques for transforming these hosts and expressing foreign DNA sequences cloned therein are well known in the art (see, e.g., Sambrook et al., ibid.). When expressing a polypeptide in bacteria such as *E. coli*, the polypeptide may be retained in the cytoplasm, typically as insoluble granules, or may be directed to the periplasmic space by a bacterial secretion sequence. In the former case, the cells are lysed, and the granules are recovered and denatured using, for example, guanidine isothiocyanate or urea. The denatured polypeptide can then be refolded and dimerized by diluting the denaturant, such as by dialysis against a solution of urea and a combination of reduced and oxidized glutathione, followed by dialysis against a buffered saline solution. In the latter case, the polypeptide can be recovered from the periplasmic space in a soluble and functional form by disrupting the cells (by, for example, sonication or osmotic shock) to release the contents of the periplasmic space and recovering the protein, thereby obviating the need for denaturation and refolding.

Transformed or transfected host cells are cultured according to conventional procedures in a culture medium containing nutrients and other components required for the growth of the chosen host cells. A variety of suitable media, including defined media and complex media, are known in the art and generally include a carbon source, a nitrogen source, essential amino acids, vitamins and minerals. Media may also contain such components as growth factors or serum, as required. The growth medium will generally select for cells containing the exogenously added DNA by, for example, drug selection or deficiency in an essential nutrient which is complemented by the selectable marker carried on the expression vector or co-transfected into the host cell.

It is preferred to purify the polypeptides and proteins of the present invention to $\geq 8001$ purity, more preferably to $\geq 90\%$ purity, even more preferably $\geq 95\%$ purity, and particularly preferred is a pharmaceutically pure state, that is greater than 99.9% pure with respect to contaminating macromolecules, particularly other proteins and nucleic acids, and free of infectious and pyrogenic agents. Preferably, a purified polypeptide or protein is substantially free of other polypeptides or proteins, particularly those of animal origin.

Expressed recombinant proteins (including single polypeptide chains, chimeric polypeptides, and polypeptide multimers) are purified by conventional protein purification methods, typically by a combination of chromatographic techniques. See, in general, *Affinity Chromatography: Principles & Methods*, Pharmacia LKB Biotechnology, Uppsala, Sweden, 1988; and Scopes, *Protein Purification: Principles and Practice*, Springer-Verlag, New York, 1994. Proteins comprising a polyhistidine affinity tag (typically about 6 histidine residues) are purified by affinity chromatography on a nickel chelate resin. See, for example, Houchuli et al., *Bio/Technol.* 6: 1321–1325, 1988. Proteins comprising a glu-glu tag can be purified by immunoaffinity chromatography essentially as disclosed by Grussenmeyer et al., ibid. Proteins comprising other affinity tags can be purified by appropriate affinity chromatography methods, which are known in the art.

Proteins of the present invention and fragments thereof can also be prepared through chemical synthesis according to methods known in the art, including exclusive solid phase synthesis, partial solid phase methods, fragment condensation or classical solution synthesis. See, for example, Merrifield, *J. Am. Chem. Soc.* 85:2149, 1963; Stewart et al., *Solid Phase Peptide Synthesis* (2nd edition), Pierce Chemical Co., Rockford, Ill., 1984; Bayer and Rapp, *Chem. Pept. Prot.* 3:3, 1986; and Atherton et al., *Solid Phase Peptide Synthesis: A Practical Approach*, IRL Press, Oxford, 1989.

Using methods known in the art, the proteins of the present invention can be prepared in a variety of modified or derivatized forms. For example, the proteins can be prepared glycosylated or non-glycosylated; pegylated or non-pegylated; and may or may not include an initial methionine amino acid residue.

Biological activities of the proteins of the present invention can be measured in vitro using cultured cells or in vivo by administering molecules of the claimed invention to the appropriate animal model. Many such assays and models are known in the art. Guidance in initial assay selection is provided by structural predictions and sequence alignments. However, even if no functional prediction is made, the activity of a protein can be elucidated by known methods, including, for example, screening a variety of target cells for a biological response, other in vitro assays, expression in a host animal, or through the use of transgenic and/or "knockout" animals. Through the application of robotics, many in vitro assays can be adapted to rapid, high-throughput screening of a large number of samples. Target cells for use in activity assays include, without limitation, vascular cells (especially endothelial cells and smooth muscle cells), hematopoietic (myeloid and lymphoid) cells, liver cells (including hepatocytes, fenestrated endothelial cells, Kupffer cells, and Ito cells), fibroblasts (including human dermal fibroblasts and lung fibroblasts), neurite cells (including astrocytes, glial cells, dendritic cells, and PC-12 cells), fetal lung cells, articular synoviocytes, pericytes, chondrocytes, osteoblasts, adipocytes, and prostate epithelial cells. Endothelial cells and hematopoietic cells are derived from a common ancestral cell, the hemangioblast (Choi et al., *Development* 125:725–732, 1998).

Biological activity can be measured with a silicon-based biosensor microphysiometer that measures the extracellular acidification rate or proton excretion associated with receptor binding and subsequent physiologic cellular responses. An exemplary such device is the Cytosensor™ Microphysiometer manufactured by Molecular Devices, Sunnyvale, Calif. A variety of cellular responses, such as cell proliferation, ion transport, energy production, inflammatory response, regulatory and receptor activation, and the like, can be measured by this method. See, for example, McConnell et al., *Science* 257:1906–1912, 1992; Pitchford et al., *Meth. Enzymol.* 228:84–108, 1997; Arimilli et al., *J. Immunol. Meth.* 212:49–59, 1998; and Van Liefde et al., *Eur. J. Pharmacol.* 346:87–95, 1998. The microphysiometer can be used for assaying adherent or non-adherent eukaryotic or prokaryotic cells. By measuring extracellular acidification changes in cell media over time, the microphysiometer directly measures cellular responses to various stimuli, including agonistic and antagonistic stimuli. Preferably, the microphysiometer is used to measure responses of a eukaryotic cell known to be responsive to the protein of interest, compared to a control eukaryotic cell that does not respond to the protein of interest. Responsive eukaryotic cells comprise cells into which a receptor for the protein of interest has been transfected, as well as naturally responsive cells. Differences in the response of cells exposed to the protein of interest, relative to a control not so exposed, are a direct measurement of protein-modulated cellular responses. Such responses can be assayed under a variety of stimuli. The present invention thus provides methods of identifying agonists and antagonists of proteins of interest, comprising providing cells responsive to a selected protein, culturing a first portion of the cells in the absence of a test compound, culturing a second portion of the cells in the presence of a test compound, and detecting a change in a cellular response of the second portion of the cells as compared to the first portion of the cells. The change in cellular response is shown as a measurable change in extracellular acidification rate. Culturing a third portion of the cells in the presence of the protein of interest and the absence of a test compound provides a positive control and a control to compare the agonist activity of a test compound with that of the protein of interest. Antagonists can be identified by exposing the cells to the protein of interest in the presence and absence of the test compound, whereby a reduction in protein-stimulated activity is indicative of antagonist activity in the test compound.

As expressed secreted proteins the MSP polypeptides disclosed herein can be used to screen for cell metabolism effecting receptors. Thus, the polypeptides of the present invention are useful for identifying new target receptors and drug design. A subset of the polypeptides disclosed herein can include membrane-bound receptors. This subset can include amongst other receptors, homologs of G protein coupled receptors, which are important mediators for cell activities including the synthesis of second messengers. Thus a set of these G protein couple receptors can mediate cel differentiation and proliferation, or hormone expression in vitro and in vivo.

Assays measuring cell proliferation or differentiation are well known in the art. For example, assays measuring proliferation include such assays as chemosensitivity to neutral red dye (Cavanaugh et al., *Investigational New Drugs* 8:347–354, 1990)., incorporation of radiolabelled nucleotides (as disclosed by, e.g., Raines and Ross, *Methods Enzymol*. 109:749–773, 1985; Wahl et al., *Mol. Cell Biol*. 8:5016–5025, 1983; and Cook et al., *Analytical Biochem*. 179:1–7, 1989), incorporation of 5-bromo-2'-deoxyuridine (BrdU) in the DNA of proliferating cells (Porstmann et al., *J. Immunol. Methods* 82:169–179, 1985), and use of tetrazolium salts (Mosmann, *J. Immunol. Methods* 65:55–63, 1983; Alley et al., *Cancer Res*. 48:589–601, 1988; Marshall et al., *Growth Reg*. 5:69–84, 1995; and Scudiero et al., *Cancer Res*. 48:4827–4833, 1988). Differentiation can be assayed using suitable precursor cells that can be induced to differentiate into a more mature phenotype. Assays measuring differentiation include, for example, measuring cell-surface markers associated with stage-specific expression of a tissue, enzymatic activity, functional activity or morphological changes (Watt, *FASEB*, 5:281–284, 1991; Francis, *Differentiation* 57:63–75, 1994; Raes, *Adv. Anim. Cell Biol. Technol. Bioprocesses*, 161–171, 1989). Effects of a protein on tumor cell growth and metastasis can be analyzed using the Lewis lung carcinoma model, for example as described by Cao et al., *J. Exp. Med*. 182:2069–2077, 1995. Activity of a protein on cells of neural origin can be analyzed using assays that measure effects on neurite growth as disclosed below.

In vitro assays for pro- and anti-inflammatory activity are known in the art. Exemplary activity assays include mitogenesis assays in which IL-1 responsive cells (e.g., D10.N4.M cells) are incubated in the presence of IL-1 or a test protein for 72 hours at 37° C. in a 5% $CO_2$ atmosphere. IL-2 (and optionally IL-4) is added to the culture medium to enhance sensitivity and specificity of the assay. $^3$H-thymidine is then added, and incubation is continued for six hours. The amount of label incorporated is indicative of agonist activity. See, Hopkins and Humphreys, *J. Immunol. Methods* 120:271–276, 1989; Greenfeder et al., *J. Biol. Chem*. 270:22460–22466, 1995. Stimulation of cell proliferation can also be measured using thymocytes cultured in a test protein in combination with phytohemagglutinin. IL-1 is used as a control. Proliferation is detected as $^3$H-thymidine incorporation or metabolic breakdown of (MTT) (Mosman, ibid.).

Protein activity may also be detected using assays designed to measure induction of one or more growth factors or other macromolecules. Preferred such assays include those for determining the presence of hepatocyte growth factor (HGF), epidermal growth factor (EGF), transforming growth factor alpha (TGFα), interleukin-6 (IL-6), VEGF, acidic fibroblast growth factor (aFGF), angiogenin, and other macromolecules produced by the liver. Suitable assays include mitogenesis assays using target cells responsive to the macromolecule of interest, receptor-binding assays, competition binding assays, immunological assays (e.g., ELISA), and other formats known in the art. Metalloprotease secretion is measured from treated primary human dermal fibroblasts, synoviocytes and chondrocytes. The relative levels of collagenase, gelatinase and stromalysin produced in response to culturing a target cell in the presence of a protein of interest is measured using zymogram gels (Loita and Stetler-Stevenson, *Cancer Biology* 1:96–106, 1990). Procollagen/collagen synthesis by dermal fibroblasts and chondrocytes in response to a test protein is measured using $^3$H-proline incorporation into nascent secreted collagen. $^3$H-labeled collagen is visualized by SDS-PAGE followed by autoradiography (Unemori and Amento, *J. Biol. Chem*. 265: 10681–10685, 1990). Glycosaminoglycan (GAG) secretion from dermal fibroblasts and chondrocytes is measured using a 1,9-dimethylmethylene blue dye binding assay (Farndale et al., *Biochim. Biophys. Acta* 883:173–177, 1986). Collagen and GAG assays are also carried out in the presence of IL-1β or TGF-β to examine the ability of a protein to modify the established responses to these cytokines.

Monocyte activation assays are carried out (1) to look for the ability of a protein of interest to further stimulate monocyte activation, and (2) to examine the ability of a protein of interest to modulate attachment-induced or endotoxin-induced monocyte activation (Fuhlbrigge et al.,*J. Immunol*. 138: 3799–3802, 1987). IL-1β and TNFα levels produced in response to activation are measured by ELISA (Biosource, Inc. Camarillo, Calif.). Monocyte/macrophage cells, by virtue of CD14 (LPS receptor), are exquisitely sensitive to endotoxin, and proteins with moderate levels of endotoxin-like activity will activate these cells.

Other metabolic effects of proteins can be measured by culturing target cells in the presence and absence of a protein and observing changes in adipogenesis, gluconeogenesis, glycogenolysis, lipogenesis, glucose uptake, or the like. Suitable assays are known in the art.

Hematopoietic activity of proteins can be assayed on various hematopoietic cells in culture. Preferred assays include primary bone marrow colony assays and later stage lineage-restricted colony assays, which are known in the art (e.g., Holly et al., WIPO Publication WO 95/21920). Marrow cells plated on a suitable semi-solid medium (e.g., 50% methylcellulose containing 15% fetal bovine serum, 10% bovine serum albumin, and 0.6% PSN antibiotic mix) are incubated in the presence of test polypeptide, then examined microscopically for colony formation. Known hematopoietic factors are used as controls. Mitogenic activity of a protein of interest on hematopoietic cell lines can be measured as disclosed above.

Cell migration is assayed essentially as disclosed by Kähler et al. (*Arteriosclerosis, Thrombosis, and Vascular Biology* 17:932–939, 1997). A protein is considered to be chemotactic if it induces migration of cells from an area of low protein concentration to an area of high protein concentration. A typical assay is performed using modified Boyden chambers with a polystryene membrane separating the two chambers (Transwell; Corning Costar Corp.). The test sample, diluted in medium containing 1% BSA, is added to the lower chamber of a 24-well plate containing Transwells. Cells are then placed on the Transwell insert that has been pretreated with 0.2% gelatin. Cell migration is measured after 4 hours of incubation at 37° C. Non-migrating cells are wiped off the top of the Transwell membrane, and cells attached to the lower face of the membrane are fixed and stained with 0.1% crystal violet. Stained cells are then extracted with 10% acetic acid and absorbance is measured at 600 nm. Migration is then calculated from a standard calibration curve. Cell migration can also be measured using the matrigel method of Grant et al. ("Angiogenesis as a component of epithelial-mesenchymal interactions" in Goldberg and Rosen, *Epithelial-Mesenchymal Interaction in Cancer*, Birkhäuser Verlag, 1995, 235–248; Baatout, *Anticancer Research* 17:451–456, 1997).

Proteins can be assayed for the ability to modulate axon guidance and growth. Suitable assays that detect changes in neuron growth patterns include, for example, those disclosed in Hastings, WIPO Publication WO 97/29189 and Walter et al., *Development* 101:685–96, 1987. Assays to measure the effects on neuron growth are well known in the art. For example, the C assay (e.g., Raper and Kapfhammer, *Neuron* 4:21–9, 1990 and Luo et al., *Cell* 75:217–27, 1993) can be used to determine collapsing activity of a protein of interest on growing neurons. Other methods that can assess protein-induced inhibition of neurite extension or divert such extension are also known. See, Goodman, *Annu. Rev. Neurosci.* 19:341–77, 1996. Conditioned media from cells expressing a protein of interest, or aggregates of such cells, can by placed in a gel matrix near suitable neural cells, such as dorsal root ganglia (DRG) or sympathetic ganglia explants, which have been co-cultured with nerve growth factor. Compared to control cells, protein-induced changes in neuron growth can be measured (as disclosed by, for example, Messersmith et al., *Neuron* 14:949–59, 1995 and Puschel et al., *Neuron* 14:941–8, 1995). Neurite outgrowth can be measured using neuronal cell suspensions grown in the presence of molecules of the present invention. See, for example, O'Shea et al., *Neuron* 7:231–7, 1991 and DeFreitas et al., *Neuron* 15:333–43, 1995.

Cell adhesion activity is assayed essentially as disclosed by LaFleur et al. (*J. Biol. Chem.* 272:32798–32803, 1997). Briefly, microtiter plates are coated with the test protein, non-specific sites are blocked with BSA, and cells (such as smooth muscle cells, leukocytes, or endothelial cells) are plated at a density of approximately $10^4$–$10^5$ cells/well. The wells are incubated at 37° C. (typically for about 60 minutes), then non-adherent cells are removed by gentle washing. Adhered cells are quantitated by conventional methods (e.g., by staining with crystal violet, lysing the cells, and determining the optical density of the lysate). Control wells are coated with a known adhesive protein, such as fibronectin or vitronectin.

Assays for angiogenic activity are also known in the art. For example, the effect of a protein of interest on primordial endothelial cells in angiogenesis can be assayed in the chick chorioallantoic membrane angiogenesis assay (Leung, *Science* 246:1306–1309, 1989; Ferrara, *Ann. NY Acad. Sci.* 752:246–256, 1995). Briefly, a small window is cut into the shell of an eight-day old fertilized egg, and a test substance is applied to the chorioallantoic membrane. After 72 hours, the membrane is examined for neovascularization. Other suitable assays include microinjection of early stage quail (Cotuinix coturnix japonica) embryos as disclosed by Drake et al. (*Proc. Natl. Acad. Sci. USA* 92:7657–7661, 1995); the rodent model of corneal neovascularization disclosed by Muthukkaruppan and Auerbach (*Science* 205:1416–1418, 1979), wherein a test substance is inserted into, a pocket in the cornea of an inbred mouse; and the hampster cheek pouch assay (Höckel et al., *Arch. Surg.* 128:423–429, 1993). Induction of vascular permeability, which is indicative of angiogenic activity, is measured in assays designed to detect leakage of protein from the vasculature of a test animal (e.g., mouse or guinea pig) after administration of a test compound (Miles and Miles, *J. Physiol.* 118:228–257, 1952; Feng et al., *J. Exp. Med.* 183:1981–1986, 1996). In vitro assays for angiogenic activity include the tridimensional collagen gel matrix model (Pepper et al. *Biochem. Biophys. Res. Comm.* 189:824–831, 1992 and Ferrara et al., *Ann. NY Acad. Sci.* 732:246–256, 1995), which measures the formation of tube-like structures by microvascular endothelial cells; and matrigel models (Grant et al., "Angiogenesis as a component of epithelial-mesenchymal interactions" in Goldberg and Rosen, *Epithelial-Mesenchymal Interaction in Cancer*, Birkhäuser Verlag, 1995, 235–248; Baatout, *Anticancer Research* 17:451–456, 1997), which are used to determine effects on cell migration and tube formation by endothelial cells seeded in matrigel, a basement membrane extract enriched in laminin. It is preferred to carry out angiogenesis assays in the presence and absence of vascular endothelial growth factor (VEGF) to assess possible combinatorial effects. It is also preferred to use VEGF as a control within in vivo assays.

Receptor binding can be measured by the competition binding method of Labriola-Tompkins et al., *Proc. Natl. Acad. Sci. USA* 88:11182–11186, 1991. In an exemplary assay for IL-1 receptor binding, membranes pepared from EL-4 thymoma cells (Paganelli et al., *J. Immunol.* 138:2249–2253, 1987) are incubated in the presence of the test protein for 30 minutes at 37° C. Labeled IL-1α or IL-1β is then added and the incubation is continued for 60 minutes. The assay is terminated by membrane filtration. The amount of bound label is determined by conventional means (e.g., γ counter). In an alternative assay, the ability of a test protein to compete with labeled IL-1 for binding to cultured human dermal fibroblasts is measured according to the method of Dower et al. (*Nature* 324:266–268, 1986). Briefly, cells are incubated in a round-bottomed, 96-well plate in a suitable culture medium (e.g., RPMI 1640 containing 1% BSA, 0.1% Na azide, and 20 mM HEPES pH 7.4) at 8° C. on a rocker platform in the presence of labeled IL-1. Various concentrations of test protein are added. After the incubation (typically about two hours), cells are separated from unbound label by centrifuging 60-μl aliquots through 200 μt of phthalate oils in 400-μl polyethylene centrifuge tubes and excising the tips of the tubes with a razor blade as disclosed by Segal and Hurwitz, *J. Immunol.* 118:1338–1347, 1977. Receptor binding assays for other cell types are known in the art. See, for example, Bowen-Pope and Ross, *Methods Enzymol.* 109:69–100, 1985.

Receptor binding can also be measured using immobilized receptors or ligand-binding receptor fragments. For example, an immobilized receptor can be exposed to its labeled ligand and unlabeled test protein, whereby a reduction in labeled ligand binding compared to a control is indicative of receptor-binding activity in the test protein.

Within another format, a receptor or ligand-binding receptor fragment is immobilized on a biosensor (e.g., BIACore™, Pharmacia Biosensor, Piscataway, N.J.) and binding is determined. Antagonists of the native ligand will exhibit receptor binding but will exhibit essentially no activity in appropriate activity assays or will reduce the ligand-mediated response when combined with the native ligand. In view of the low level of receptor occupancy required to produce a response to some ligands (e.g., IL-1), a large excess of antagonist (typically a 10- to 1000-fold molar excess) may be necessary to neutralize ligand activity.

Receptor activation can be detected in target cells by: (1) measurement of adenylate cyclase activity (Salomon et al., *Anal. Biochem.* 58:541–48, 1974; Alvarez and Daniels, *Anal. Biochem.* 187:98–103, 1990); (2) measurement of change in intracellular cAMP levels using conventional radioimmunoassay methods (Steiner et al., *J. Biol. Chem.* 247:1106–13, 1972; Harper and Brooker, *J. Cyc. Nucl. Res.* 1:207–18, 1975); or (3) through use of a cAMP scintillation proximity assay (SPA) method (such as available from Amersham Corp., Arlington Heights, Ill.).

Proteins can be tested for serine protease activity or proteinase inhibitory activity using conventional assays. Substrate cleavage is conveniently assayed using a tetrapeptide that mimics the cleavage site of the natural substrate and which is linked, via a peptide bond, to a carboxyl-terminal para-nitio-anilide (pNA) group. The protease hydrolyzes the bond between the fourth amino acid residue and the pNA group, causing the pNA group to undergo a dramatic increase in absorbance at 405 nm. Suitable substrates can be synthesized according to known methods or obtained from commercial suppliers. Inhibitory activity is measured by adding a test sample to a reaction mixture containing enzyme and substrate, and comparing the observed enzyme activity to a control (without the test sample). A variety of such assays are known in the art, including assays measuring inhibition of trypsin, chymotrypsin, plasmin, cathepsin G, and human leukocyte elastase. See, for example, Petersen et al., *Eur. J. Biochem.* 235:310–316, 1996. In a typical procedure, the inhibitory activity of a test compound is measured by incubating the test compound with the proteinase, then adding an appropriate substrate, typically a chromogenic peptide substrate. See, for example, Norris et al. (*Biol. Chem. Hoppe-Seyler* 371:37–42, 1990). Various concentrations of the inhibitor are incubated in the presence of trypsin, plasmin, and plasma kallikrein in a low-salt buffer at pH 7.4, 25° C. After 30 minutes, the residual enzymatic activity is measured by the addition of a chromogenic substrate (e.g., S2251 (D-Val-Leu-Lys-Nan) or S2302 (D-Pro-Phe-Arg-Nan), available from Kabi, Stockholm, Sweden) and a 30-minute incubation. Inhibition of enzyme activity is indicated by a decrease in absorbance at 405 nm or fluorescence Em at 460 nm. From the results, the apparent inhibition constant $K_i$ is calculated. When a serine protease is prepared as an active precursor (e.g., comprising N-terminal residues 1–109 of SEQ ID NO:2), it is activated by cleavage with a suitable protease (e.g., furin (Steiner et al., *J. Biol. Chem.* 267:23435–23438, 1992)) prior to assay. Assays of this type are well known in the art. See, for example, Lottenberg et al., *Thrombosis Research* 28:313–332, 1982; Cho et al., *Biochem.* 23:644–650, 1984; Foster et al., *Biochem.* 26:7003–7011, 1987). The inhibition of coagulation factors (e.g., factor VIIa, factor Xa) can be measured using chromogenic substrates or in conventional coagulation assays (e.g., clotting time of normal human plasma; Dennis et al., *J. Biol. Chem.* 270:25411–25417, 1995).

Blood coagulation and chromogenic assays, which can be used to detect both procoagulant, anticoagulant, and thrombolytic activities, are known in the art. For example, pro- and anticoagulant activities can be measured in a one-stage clotting assay using platelet-poor or factor-deficient plasma (Levy and Edgington, *J. Exp. Med.* 151:1232–1243, 1980; Schwartz et al., *J. Clin. Invest.* 67:1650–1658, 1981). As disclosed by Anderson et al. (*Proc. Natl. Acad. Sci. USA* 96:11189–11193, 1999), the effect of a test compound on platelet activation can be determined by a change in turbidity, and the procoagulant activity of activated platelets can be determined in a phospholipid-dependent coagulation assay. Activation of thrombin can be determined by hydrolysis of peptide p-nitroanilide substrates as disclosed by Lottenberg et al. (*Thrombosis Res.* 28:313–332, 1982). Other procoagulant, anticoagulant, and thrombolytic activities can be measured using appropriate chromogenic substrates, a variety of which are available from commercial suppliers. See, for example, Kettner and Shaw, *Methods Enzymol.* 80:826–842, 1981.

Anti-microbial activity of proteins is evaluated by techniques that are known in the art. For example, anti-microbial activity can be assayed by evaluating the sensitivity of microbial cell cultures to test agents and by evaluating the protective effect of test agents on infected mice. See, for example, Musiek et al., *Antimicrob. Agents Chemothr.* 3:40, 1973. Antiviral activity can also be assessed by protection of mammalian cell cultures. Known techniques for evaluating anti-microbial activity include, for example, Barsum et al., *Eur. Respir. J.* 8:709–714, 1995; Sandovsky-Losica et al., *J. Med. Vet. Mycol (England)* 28:279–287, 1990; Mehentee et al., *J. Gen. Microbiol (England)* 135(:2181–2188, 1989; and Segal and Savage, *J. Med. Vet. Mycol.* 24:477–479, 1986. Assays specific for anti-viral activity include, for example, those described by Daher et al., *J. Virol.* 60:1068–1074, 1986.

The assays disclosed above can be modified by those skilled in the art to detect the presence of agonists and antagonists of a selected protein of interest.

Expression of a polynucleotide encoding a protein of interest in animals provides models for further study of the biological effects of overproduction or inhibition of protein activity in vivo. Polynucleotides and antisense polynucleotides can be introduced into test animals, such as mice, using viral vectors or naked DNA, or transgenic animals can be produced.

One in vivo approach for assaying proteins of the present invention utilizes viral delivery systems. Exemplary viruses for this purpose include adenovirus, herpesvirus, retroviruses, vaccinia virus, and adeno-associated virus (AAV). Adenovirus, a double-stranded DNA virus, is currently the best studied gene transfer vector for delivery of heterologous nucleic acids. For review, see Becker et al., *Meth. Cell Biol.* 43:161–89, 1994; and Douglas and Curiel, *Science & Medicine* 4:44–53, 1997. The adenovirus system offers several advantages. Adenovirus can (i) accommodate relatively large DNA inserts; (ii) be grown to high-titer; (iii) infect a broad range of mammalian cell types; and (iv) be used with many different promoters including ubiquitous, tissue specific, and regulatable promoters. Because adenoviruses are stable in the bloodstream, they can be administered by intravenous injection.

By deleting portions of the adenovirus genome, larger inserts (up to 7 kb) of heterologous DNA can be accommodated. These inserts can be incorporated into the viral DNA by direct ligation or by homologous recombination with a co-transfected plasmid. In an exemplary system, the essential E1 gene is deleted from the viral vector, and the virus will not replicate unless the E1 gene is provided by the host cell (e.g., the human 293 cell line). When intravenously administered to intact animals, adenovirus primarily targets the liver. If the adenoviral delivery system has an E1 gene deletion, the virus cannot replicate in the host cells.

However, the host's tissue (e.g., liver) will express and process (and, if a signal sequence is present, secrete) the heterologous protein. Secreted proteins will enter the circulation in the highly vascularized liver, and effects on the infected animal can be determined.

An alternative method of gene delivery comprises removing cells from the body and introducing a vector into the cells as a naked DNA plasmid. The transformed cells are then re-implanted in the body. Naked DNA vectors are introduced into host cells by methods known in the art, including transfection, electroporation, microinjection, transduction, cell fusion, DEAE dextran, calcium phosphate precipitation, use of a gene gun, or use of a DNA vector transporter. See, Wu et al., *J. Biol. Chem.* 263:14621–14624, 1988; Wu et al., *J. Biol. Chem.* 267:963–967, 1992; and Johnston and Tang, *Meth. Cell Biol.* 43:353–365, 1994.

Transgenic mice, engineered to express a gene encoding a protein of interest, and mice that exhibit a complete absence of gene function, referred to as "knockout mice" (Snouwaert et al., *Science* 257:1083, 1992), can also be generated (Lowell et al., *Nature* 366:740–742, 1993). These mice can be employed to study the gene of interest and the protein encoded thereby in an in vivo system. Transgenic mice are particularly useful for investigating the role of proteins in early development in that they allow the identification of developmental abnormalities or blocks resulting from the over- or underexpression of a specific factor. See also, Maisonpierre et al., *Science*277:55–60, 1997 and Hanahan, *Science* 277:48–50, 1997. Preferred promoters for transgenic expression include promoters from metallothionein and albumin genes. As disclosed above, the human sequences provided herein can be used to clone orthologous polynucleotides, which may be preferred for use in generating transgenic and knockout animals.

Antisense methodology can be used to inhibit gene transcription to examine the effects of such inhibition in vivo. Polynucleotides that are complementary to a segment of a protein-encoding polynucleotide are designed to bind to the encoding mRNA and to inhibit translation of such mRNA. Such antisense oligonucleotides can also be used to inhibit expression of protein-encoding genes in cell culture.

Biological activities of test proteins can also be measured in animal models by administering the test protein, by itself or in combination with other agents, including other proteins. Using such models facilitates the assay of the test protein by itself or as an inhibitor or modulator of another agent, and also facilitates the measurement of combinatorial effects of bioactive compounds.

Anti-inflammatory activity can be tested in animal models of inflammatory disease. For example, animal models of psoriasis include the analysis of histological alterations in adult mouse tail epidermis (Hofbauer et al, *Brit. J. Dermatol.* 118:85–89, 1988; Bladon et al., *Arch Dermatol. Res.* 277:121–125, 1985). In this model, anti-psoriatic activity is indicated by the induction of a granular layer and orthokeratosis in areas of scale between the hinges of the tail epidermis. Typically, a topical ointment comprising a test compound is applied daily for seven consecutive days, then the animal is sacrificed, and tail skin is examined histologically. An additional model is provided by grafting psoriatic human skin to congenitally athymic (nude) mice (Krueger et al., *J. Invest. Dermatol.* 64:307–312, 1975). Such grafts have been shown to retain the characteristic histology for up to eleven weeks. As in the mouse tail model, the test composition is applied to the skin at predetermined intervals for a period of one to several weeks, at which time the animals are sacrificed and the skin grafts examined histologically. A third model has been disclosed by Fretland et al. (*Inflammation* 14:727–739, 1990). Briefly, inflammation is induced in guinea pig epidermis by topically applying phorbol ester (phorbol-12-myristate-13-acetate; PMA), typically at ca. 2 g/ml in acetone, to one ear and vehicle to the contralateral ear. Test compounds are applied concurrently with the PMA, or may be given orally. Histological analysis is performed at 96 hours after application of PMA. This model duplicates many symptoms of human psoriasis, including edema, inflammatory cell diapedesis and infiltration, high $LTB_4$ levels and epidermal proliferation.

Cerebral ischemia can be studied in a rat model as disclosed by Relton et al. (ibid.) and Loddick et al. (ibid.).

The effect of a test protein on primordial endothelial cells in angiogenesis can be assayed in the chick chorioallantoic membrane angiogenesis assay (Leung, *Science* 246:1306–1309, 1989; Ferrara, *Ann. NY Acad. Sci.* 752:246–256, 1995). Briefly, a small window is cut into the shell of an eight-day old fertilized egg, and a test substance is applied to the chorioallantoic membrane. After 72 hours, the membrane is examined for neovascularization. Embryo microinjection of early stage quail (*Coturnix coturnix japonica*) embryos can also be used (Drake et al., *Proc. Natl. Acad. Sci. USA* 92:7657–7661, 1995). Briefly, a solution containing the protein is injected into the interstitial space between the endoderm and the splanchnic mesoderm of early-stage embryos using a micropipette and micromanipulator system. After injection, embryos are placed ventral side down on a nutrient agar medium and incubated for 7 hours at 37° C. in a humidified $CO_2$/air mixture (10%/90%). Vascular development is assessed by microscopy of fixed, whole-mounted embryos and sections.

Stimulation of coronary collateral growth can be measured in known animal models, including a rabbit model of peripheral limb ischemia and hind limb ischemia and a pig model of chronic myocardial ischemia (Ferrara et al., *Endocrine Reviews* 18:4–25, 1997). Test proteins are assayed in the presence and absence of VEGF and basic FGF to test for combinatorial effects. These models can be modified by the use of adenovirus or naked DNA for gene delivery as disclosed in more detail above, resulting in local expression of the test protein(s).

Angiogenic activity can also be tested in a rodent model of corneal neovascularization as disclosed by Muthukkaruppan and Auerbach, *Science* 205:1416–1418, 1979, wherein a test substance is inserted into a pocket in the cornea of an inbred mouse. For use in this assay, proteins are combined with a solid or semi-solid, biocompatible carrier, such as a polymer pellet. Angiogenesis is followed microscopically. Vascular growth into the corneal stroma can be detected in about 10 days.

Angiogenic activity can also be tested in the hampster cheek pouch assay (Höckel et al., *Arch. Surg.* 128:423–429, 1993). A test substance is injected subcutaneiously into the cheek pouch, and after five days the pouch is examined under low magnification to determine the extent of neovascularization. Tissue sections can also be examined histologically.

Induction of vascular permeability is measured in assays designed to detect leakage of protein from the vasculature of a test animal (e.g., mouse or guinea pig) after administration of a test compound (Miles and Miles, *J. Physiol.* 118:228–257, 1952; Feng et al., *J. Exp. Med.* 183:1981–1986, 1996).

Wound-healing models include the linear skin incision model of Mustoe et al. (*Science* 237:1333, 1987). In a typical procedure, a 6-cm incision is made in the dorsal pelt of an adult rat, then closed with wound clips. Test substances and controls (in solution, gel, or powder form) are applied before primary closure. It is preferred to limit administration to a single application, although additional applications can be made on succeeding days by careful injection at several sites under the incision. Wound breaking strength is evaluated between 3 and 21 days post wounding. In a second model, multiple, small, full-thickness excisions are made on the ear of a rabbit. The cartilage in the ear splints the wound, removing the variable of wound contraction from the evaluation of closure. Experimental treatments and controls are applied. The geometry and anatomy of the wound site allow for reliable quantification of cell ingrowth and epithelial migration, as well as quantitative analysis of the biochemistry of the wounds (e.g., collagen content). See, Mustoe et al., *J. Clin. Invest.* 87:694, 1991. The rabbit ear model can be modified to create an ischemic wound environment, which more closely resembles the clinical situation (Ahn et al., *Ann. Plast. Surg.* 24:17, 1990). Within a third model, healing of partial-thickness skin wounds in pigs or guinea pigs is evaluated (LeGrand et al., *Growth Factors* 8:307, 1993). Experimental treatments are applied daily on or under dressings. Seven days after wounding, granulation tissue thickness is determined. This model is preferred for dose-response studies, as it is more quantitative than other in vivo models of wound healing. A full thickness excision model can also be employed. Within this model, the epidermis and dermis are removed down to the panniculus carnosum in rodents or the subcutaneous fat in pigs. Experimental treatments are applied topically on or under a dressing, and can be applied daily if desired. The wound closes by a combination of contraction and cell ingrowth and proliferation. Measurable endpoints include time to wound closure, histologic score, and biochemical parameters of wound tissue. Impaired wound healing models are also known in the art (e.g., Cromack et al., *Surgery* 113:36, 1993; Pierce et al., *Proc. Natl. Acad. Sci. USA* 86:2229, 1989; Greenhalgh et al., *Amer. J. Pathol.* 136:1235, 1990). Delay or prolongation of the wound healing process can be induced pharmacologically by treatment with steroids, irradiation of the wound site, or by concomitant disease states (e.g., diabetes). Linear incisions or full-thickness excisions are most commonly used as the experimental wound. Endpoints are as disclosed above for each type of wound. Subcutaneous implants can be used to assess compounds acting in the early stages of wound healing (Broadley et al., *Lab. Invest.* 61:571, 1985; Sprugel et al., *Amer. J. Pathol.* 129: 601, 1987). Implants are prepared in a porous, relatively non-inflammatory container (e.g., polyethylene sponges or expanded polytetrafluoroethylene implants filled with bovine collagen) and placed subcutaneously in mice or rats. The interior of the implant is empty of cells, producing a "wound space" that is well-defined and separable from the preexisting tissue. This arrangement allows the assessment of cell influx and cell type as well as the measurement of vasculogenesis/angiogenesis and extracellular matrix production.

Inhibition of tumor metastasis can be assessed in mice into which cancerous cells or tumor tissue have been introduced by implantation or injection (e.g., Brown, *Advan. Enzyme Regul.* 35:293–301, 1995; Conway et al., *Clin. Exp. Metastasis* 14:115–124, 1996).

Effects on fibrinolysis can be measured in a rat model wherein the enzyme batroxobin and radiolabeled fibrinogen are administered to test animals. Inhibition of fibrinogen activation by a test compound is seen as a reduction in the circulating level of the label as compared to animals not receiving the test compound. See, Lenfors and Gustafsson, *Semin. Thromb. Hemost.* 22:335–342, 1996.

The invention further provides polypeptides that comprise an epitope-bearing portion of a protein as shown in SEQ ID NO:M, wherein M is an even integer from 2 to 328. An "epitope" is a region of a protein to which an antibody can bind. See, for example, Geysen et al., *Proc. Natl. Acad. Sci. USA* 81:3998–4002, 1984. Epitopes can be linear or conformational, the latter being composed of discontinuous regions of the protein that form an epitope upon folding of the protein. Linear epitopes are generally at least 6 amino acid residues in length. Relatively short synthetic peptides that mimic part of a protein sequence are routinely capable of eliciting an antiserum that reacts with the partially mimicked protein. See, for example, Sutcliffe et al., *Science* 219:660–666, 1983. Antibodies that recognize short, linear epitopes are particularly useful in analytic and diagnostic applications that employ denatured protein, such as Western blotting (Tobin, *Proc. Natl. Acad. Sci. USA* 76:4350–4356, 1979). Antibodies to short peptides may also recognize proteins in native conformation and will thus be useful for monitoring protein expression and protein isolation, and in detecting proteins in solution, such as by ELISA or in immunoprecipitation studies.

Antigenic, epitope-bearing polypeptides of the present invention are useful for raising antibodies, including monoclonal antibodies, that specifically bind to the corresponding protein. Antigenic, epitope-bearing polypeptides contain a sequence of at least six, preferably at least nine, more preferably from 15 to about 30 contiguous amino acid residues of a protein. Within certain embodiments of the invention, the polypeptides comprise 40, 50, 100, or more contiguous residues of a protein as shown in SEQ ID NO:M, up to the entire predicted mature protein or the primary translation product. It is preferred that the amino acid sequence of the epitope-bearing polypeptide is selected to provide substantial solubility in aqueous solvents, that is the sequence includes relatively hydrophilic residues, and hydrophobic residues are substantially avoided. Table 7 lists preferred hexapeptides for use as antigens. Within Table 7, each the amino termini of the hexapeptides are specified. Those skilled in the art will recognize that longer polypeptides comprising these hexapeptides can also be used and will often be preferred.

TABLE 7

| Protein | Hexapeptide N-termini | | | | |
|---|---|---|---|---|---|
| Z1055G2P | 113 | 112 | 109 | 47 | 46 |
| Z1183G7P | 41 | 87 | 40 | 39 | 95 |
| Z125G9P | 72 | 70 | 19 | 18 | 68 |
| Z128G9P | 171 | 181 | 170 | 2 | 187 |
| Z1297G2P | 349 | 328 | 346 | 193 | 326 |
| Z1345G3P | 46 | 58 | 1 | 41 | 57 |
| Z1345G5P | 151 | 6 | 150 | 82 | 149 |
| Z1659G4P | 168 | 121 | 120 | 133 | 132 |
| Z2007G2P | 132 | 125 | 131 | 55 | 54 |
| Z2263G5P | 145 | 144 | 113 | 112 | 74 |
| Z25829G3P | 104 | 118 | 101 | 115 | 100 |
| Z25999G1P | 66 | 65 | 88 | 57 | 64 |
| Z27842G1P | 117 | 116 | 115 | 114 | 78 |
| Z2812G3P | 139 | 145 | 138 | 2 | 49 |
| Z281G1P | 100 | 99 | 18 | 92 | 98 |
| Z2839G2P | 68 | 169 | 6 | 67 | 4 |
| Z287G9P | 112 | 65 | 102 | 2 | 1 |
| Z2887G7P | 87 | 139 | 123 | 25 | 36 |
| Z2972G5P | 83 | 39 | 82 | 38 | 79 |
| Z297G1P | 105 | 104 | 103 | 2 | 62 |
| Z3038G1P | 87 | 84 | 103 | 50 | 100 |
| Z321375G1P | 6 | 49 | 5 | 60 | 59 |
| Z3264G1P | 139 | 138 | 70 | 137 | 69 |
| Z3357G2P | 115 | 107 | 114 | 99 | 113 |
| Z4256G1P | 317 | 169 | 222 | 57 | 310 |
| Z4384G2P | 223 | 69 | 41 | 222 | 82 |
| Z446500G1P | 38 | 63 | 37 | 46 | 62 |
| Z4622G1P | 71 | 21 | 62 | 20 | 52 |
| Z4670G1P | 43 | 62 | 2 | 42 | 13 |
| Z555G20P | 155 | 34 | 110 | 101 | 154 |
| Z577G9P | 121 | 120 | 145 | 144 | 104 |
| Z700497G2P | 73 | 64 | 89 | 43 | 88 |
| Z700823G2P | 107 | 73 | 12 | 35 | 57 |
| Z700996G11P | 24 | 31 | 78 | 30 | 39 |

TABLE 7-continued

| Protein | Hexapeptide N-termini | | | | |
|---|---|---|---|---|---|
| Z701935G4P | 90 | 2 | 33 | 96 | 89 |
| Z702408G2P | 91 | 80 | 26 | 79 | 90 |
| Z74922G1P | 54 | 36 | 53 | 119 | 52 |
| Z790708G1P | 214 | 149 | 41 | 212 | 201 |
| Z791735G1P | 49 | 48 | 91 | 2 | 90 |
| Z792987G7P | 85 | 208 | 207 | 84 | 121 |
| Z793561G4P | 56 | 51 | 49 | 48 | 34 |
| Z794249G2P | 388 | 380 | 463 | 199 | 38 |
| Z799543G2P | 145 | 144 | 97 | 143 | 38 |
| Z807106G2P | 1 | 121 | 51 | 47 | 80 |
| Z807166G2P | 118 | 61 | 28 | 71 | 27 |
| Z807270G7P | 56 | 195 | 194 | 163 | 55 |
| Z807340G6P | 6 | 78 | 5 | 39 | 4 |
| Z807941G1P | 115 | 70 | 113 | 112 | 69 |
| Z809241G11P | 82 | 80 | 131 | 79 | 36 |
| Z809335G4P | 680 | 664 | 679 | 339 | 163 |
| Z809469G10P | 146 | 145 | 89 | 34 | 116 |
| Z835361G1P | 132 | 131 | 77 | 1 | 76 |
| Z835510G5P | 107 | 232 | 248 | 230 | 222 |
| Z835548G2P | 155 | 52 | 82 | 153 | 137 |
| Z835840G8P | 19 | 217 | 63 | 216 | 235 |
| Z835892G6P | 99 | 98 | 133 | 59 | 158 |
| Z835944G6P | 89 | 44 | 88 | 42 | 50 |
| Z835999G1P | 48 | 47 | 27 | 45 | 26 |
| Z836222G4P | 127 | 89 | 135 | 133 | 125 |
| Z836250G2P | 106 | 105 | 104 | 103 | 78 |
| Z836307G1P | 57 | 65 | 56 | 64 | 55 |
| Z836325G9P | 85 | 84 | 93 | 50 | 73 |
| Z836355G5P | 149 | 148 | 2 | 1 | 145 |
| Z837892G2P | 76 | 104 | 66 | 75 | 65 |
| Z838027G3P | 103 | 50 | 101 | 160 | 100 |
| Z838054G2P | 78 | 77 | 76 | 56 | 20 |
| Z838468G2P | 42 | 58 | 55 | 51 | 3 |
| Z842039G5P | — | 1 | 24 | 23 | 22 |
| Z842046G1P | 60 | 51 | 50 | 22 | 48 |
| Z846090G4P | 25 | 24 | 86 | 35 | 23 |
| Z846280G2P | 143 | 28 | 39 | 140 | 38 |
| Z846300G9P | 106 | 68 | 123 | 104 | 30 |
| Z846363G2P | 117 | 116 | 115 | 207 | 114 |
| Z846626G9P | 48 | 65 | 121 | 47 | 46 |
| Z846631G3P | 131 | 130 | 51 | 106 | 76 |
| Z849065G4P | 206 | 205 | 159 | 203 | 213 |
| Z849135G16P | 2 | 1 | 210 | 50 | 209 |
| Z849162G4P | 63 | 30 | 62 | 39 | 29 |
| Z849213G14P | 30 | 79 | 56 | 25 | 78 |
| Z849221G9P | 201 | 122 | 200 | 199 | 163 |
| Z849314G5P | 113 | 124 | 123 | 135 | 133 |
| Z849377G7P | 134 | 152 | 53 | 92 | 52 |
| Z849533G7P | 88 | 127 | 126 | 87 | 59 |
| Z849559G5P | 34 | 60 | 32 | 2 | 124 |
| Z849746G1P | 172 | 171 | 170 | 42 | 41 |
| Z849893G9P | 41 | 91 | 27 | 24 | 65 |
| Z855073G14P | 36 | 50 | 123 | 35 | 122 |
| Z855260G4P | 147 | 42 | 41 | 76 | 75 |
| Z869105G16P | 24 | 22 | 71 | 20 | 70 |
| Z869173G14P | 88 | 87 | 24 | 86 | 22 |
| Z869333G11P | 81 | 36 | 77 | 76 | 74 |
| Z869654G5P | 36 | 34 | 51 | 2 | 32 |
| Z869671G3P | 288 | 54 | 287 | 239 | 121 |
| Z869719G6P | 168 | 102 | 101 | 142 | 100 |
| Z873630G11P | 135 | 134 | 47 | 133 | 44 |
| Z873683G5P | 113 | 112 | 111 | 62 | 45 |
| Z873717G10P | 77 | 76 | 40 | 75 | 39 |
| Z873745G3P | 1 | 8 | 112 | 127 | 125 |
| Z873811G8P | 83 | 40 | 78 | 38 | 144 |
| Z873818G10P | 43 | 42 | 39 | 111 | 149 |
| Z874015G4P | 86 | 85 | 254 | 245 | 84 |
| Z874090G3P | 37 | 35 | 43 | 34 | 77 |
| Z874090G4P | 180 | 21 | 90 | 19 | 2 |
| Z874178G8P | 45 | 112 | 59 | 58 | 57 |
| Z874193G6P | 26 | 225 | 24 | 224 | 50 |
| Z875409G1P | 32 | 22 | 30 | 16 | 75 |
| Z877091G9P | 57 | 156 | 36 | 155 | 56 |
| Z877300G8P | 99 | 86 | 98 | 153 | 152 |
| Z877532G7P | 18 | 17 | 16 | 56 | 15 |
| Z877574G3P | 23 | 135 | 87 | 83 | 105 |
| Z877975G4P | 99 | 98 | 43 | 42 | 56 |
| Z887014G7P | 101 | 47 | 128 | 35 | 119 |
| Z887031G1P | 196 | 30 | 193 | 232 | 230 |
| Z887042G3P | 172 | 60 | 267 | 121 | 51 |
| Z887280G5P | 93 | 92 | 108 | 45 | 91 |
| Z887300G2P | 41 | 40 | 2 | 1 | 93 |
| Z888627G9P | 57 | 156 | 36 | 155 | 56 |
| Z888644G7P | 163 | 123 | 122 | 162 | 101 |
| Z888879G3P | 86 | 75 | 37 | 36 | 32 |
| Z890990G20P | 103 | 145 | 102 | 118 | 137 |
| Z891399G5P | 152 | 151 | 149 | 178 | 148 |
| Z891519G8P | 21 | 109 | 1 | 69 | 107 |
| Z891532G2P | 103 | 102 | 101 | 80 | 79 |
| Z891575G17P | 123 | 140 | 79 | 122 | 75 |
| Z891639G1P | 91 | 157 | 90 | 156 | 89 |
| Z891682G2P | 2 | 173 | 1 | 141 | 122 |
| Z891886G1P | 127 | 126 | 124 | 84 | 64 |
| Z892025G7P | 101 | 236 | 90 | 87 | 260 |
| Z892026G1P | 74 | 24 | 81 | 90 | 72 |
| Z903906G4P | 1 | 39 | 97 | 64 | 96 |
| Z908203G11P | 119 | 117 | 31 | 102 | 99 |
| Z908225G14P | 90 | 44 | 132 | 131 | 127 |
| Z908460G2P | 93 | 92 | 91 | 152 | 37 |
| Z908463G2P | 155 | 51 | 50 | 140 | 154 |
| Z908593G16P | 58 | 189 | 25 | 114 | 169 |
| Z908644G15P | 146 | 144 | 260 | 198 | 38 |
| Z908655G7P | 102 | 88 | 177 | 36 | 101 |
| Z908668G10P | 154 | 21 | 52 | 116 | 115 |
| Z908874G13P | 113 | 124 | 123 | 135 | 133 |
| Z908957G1P | 17 | 16 | 59 | 82 | 15 |
| Z909165G15P | 138 | 39 | 49 | 137 | 151 |
| Z909204G1P | 29 | 59 | 82 | 42 | 58 |
| Z909337G10P | 72 | 7 | 31 | 30 | 93 |
| Z909460G4P | 146 | 138 | 145 | 108 | 135 |
| Z910197G6P | 85 | 84 | 158 | 167 | 174 |
| Z912187G1P | 84 | 183 | 2 | 1 | 109 |
| Z913549G1P | 63 | 62 | 203 | 60 | 57 |
| Z930005G2P | 1 | 155 | 154 | 21 | 104 |
| Z930582G14P | 206 | 205 | 159 | 203 | 213 |
| Z930757G12P | 105 | 103 | 89 | 29 | 102 |
| Z930798G6P | 53 | 51 | 49 | 115 | 108 |
| Z930857G2P | 297 | 296 | 294 | 292 | 291 |
| Z930898G2P | 206 | 99 | 198 | 197 | 205 |
| Z931019G1P | 24 | 23 | 152 | 13 | 21 |
| Z931276G1P | 130 | 127 | 240 | 123 | 120 |
| Z931363G4P | 131 | 154 | 42 | 27 | 39 |
| Z931654G1P | 31 | 2 | 1 | 46 | 30 |
| Z931828G2P | 41 | 40 | 62 | 93 | 39 |
| Z931874G4P | 87 | 139 | 123 | 25 | 36 |
| Z935148G9P | 191 | 190 | 79 | 166 | 58 |
| Z935205G2P | 107 | 82 | 105 | 68 | 67 |
| Z935414G4P | 273 | 247 | 224 | 140 | 272 |
| Z935553G3P | 2 | 175 | 118 | 1 | 174 |
| Z935805G4P | 216 | 213 | 202 | 56 | 201 |

As used herein, the term "antibodies" includes polyclonal antibodies, monoclonal antibodies, antigen-binding fragments thereof such as F(ab')$_2$ and Fab fragments, single chain antibodies, and the like, including genetically engineered antibodies. Non-human antibodies can be humanized by grafting only non-human CDRs onto human framework and constant regions, or by incorporating the entire non-human variable domains (optionally "cloaking" them with a human-like surface by replacement of exposed residues, wherein the result is a "veneered" antibody). In some instances, humanized antibodies may retain non-human residues within the human variable region framework domains to enhance proper binding characteristics. Through humanizing antibodies, biological half-life may be increased, and the potential for adverse immune reactions upon administration to humans is reduced. One skilled in the art can generate humanized antibodies with specific and different constant domains (i.e., different Ig subclasses) to facilitate or inhibit various immune functions associated with particular antibody constant domains.

Alternative techniques for generating or selecting antibodies useful herein include in vitro exposure of lymphocytes to an immunogenic polypeptide, and selection of antibody display libraries in phage or similar vectors (for instance, through use of an immobilized or labeled polypeptide). Human antibodies can be produced in transgenic, non-human animals that have been engineered to contain human immunoglobulin genes as disclosed in WIPO Publication WO 98/24893. It is preferred that the endogenous immunoglobulin genes in these animals be inactivated or eliminated, such as by homologous recombination.

Antibodies are defined to be specifically binding if they bind to a target polypeptide with an affinity at least 10-fold greater than the binding affinity to control (non-target) polypeptide. It is preferred that the antibodies exhibit a binding affinity ($K_a$) of $10^6$ $M^{-1}$ or greater, preferably $10^7$ $M^{-1}$ or greater, more preferably $10^8$ $M^{-1}$ or greater, and most preferably $10^9$ $M^{-1}$ or greater. The affinity of a monoclonal antibody can be readily determined by one of ordinary skill in the art (see, for example, Scatchard, *Ann. NY Acad. Sci.* 51: 660–672, 1949).

Methods for preparing polyclonal and monoclonal antibodies are well known in the art (see for example, Hurrell, J. G. R., Ed., *Monoclonal Hybridoma Antibodies: Techniques and Applications*, CRC Press, Inc., Boca Raton, Fla., 1982). As would be evident to one of ordinary skill in the art, polyclonal antibodies can be generated from a variety of warm-blooded animals such as horses, cows, goats, sheep, dogs, chickens, rabbits, mice, and rats. The immunogenicity of a polypeptide immunogen may be increased through the use of an adjuvant such as alum (aluminum hydroxide) or Freund's complete or incomplete adjuvant. Polypeptides useful for immunization also include fusion polypeptides, such as fusions of a polypeptide of interest or a portion thereof with an immunoglobulin polypeptide or with maltose binding protein. The polypeptide immunogen may be a full-length molecule or a portion thereof. If the polypeptide portion is "hapten-like", such portion may be advantageously joined or linked to a macromolecular carrier (such as keyhole limpet hemocyanin (KLH), bovine serum albumin (BSA) or tetanus toxoid) for immunization.

A variety of assays known to those skilled in the art can be utilized to detect antibodies that specifically bind to a polypeptide of interest. Exemplary assays are described in detail in *Antibodies: A Laboratory Manual*, Harlow and Lane (Eds.), Cold Spring Harbor Laboratory Press, 1988. Representative examples of such assays include concurrent immunoelectrophoresis, radio-immunoassays, radio-immunoprecipitations, enzyme-linked immunosorbent assays (ELISA), dot blot assays, Western blot assays, inhibition or competition assays, and sandwich assays.

Antibodies can be used, for example, to isolate target polypeptides by affinity purification, for diagnostic assays for determining circulating or localized levels of target polypeptides, for tissue typing, for cell sorting, for screening expression libraries; for generating anti-idiotypic antibodies, and as neutralizing antibodies or as antagonists to block protein activity in vitro and in vivo.

Additionally, antibodies generated to the MSP proteins described herein can be used, either individually or in combination, to monitor these proteins in bodily fluids. In particular, correlating changes in the level of expression of the MSP proteins with changes in metabolism, or progression of disease would be useful in studying metabolism disorders or monitoring the improvement or decline of diseases.

Polynucleotides and polypeptides of the present invention will additionally find use as educational tools as a laboratory practicum kits for courses related to genetics and molecular biology, protein chemistry and antibody production and analysis. Due to their unique polynucleotide and polypeptide sequences molecules of MSP can be used as standards or as "unknowns" for testing purposes. For example, MSP polynucleotides can be used as aids, such as, for example, to teach a student how to prepare expression constructs for bacterial, viral, and/or mammalian expression, including fusion constructs, wherein MSP are the genes to be expressed; for determining the restriction endonuclease cleavage sites of the polynucleotides; determining mRNA and DNA localizations of MSP polynucleotides in tissues (i.e., by Northern and Southern blotting as well as polymerase chain reaction); and for identifying related polynucleotides and polypeptides by nucleic acid hybridization.

MSP polypeptides can be used educationally as aids to teach preparation of antibodies; identifying proteins by Western blotting; protein purification; determining the weight of expressed MSP polypeptides as a ratio to total protein expressed; identifying peptide cleavage sites; coupling amino and carboxyl terminal tags; amino acid sequence analysis, as well as, but not limited to monitoring biological activities of both the native and tagged protein (i.e., receptor binding, signal transduction, proliferation, and differentiation) in vitro and in vivo. MSP polypeptides can also be used to teach analytical skills such as mass spectrometry, circular dichroism to determine conformation, in particular the locations of the disulfide bonds, x-ray crystallography to determine the three-dimensional structure in atomic detail, nuclear magnetic resonance spectroscopy to reveal the structure of proteins in solution. For example, a kit containing the MSP can be given to the student to analyze. Since the amino acid sequences would be known by the professor, the proteins can be given to the student as a test to determine the skills or develop the skills of the student, the teacher would then know whether or not the student has correctly analyzed the polypeptides. Since every polypeptide is unique, the educational utility of each MSP would be unique unto itself.

The antibodies which bind specifically to a MSP can be used as a teaching aid to instruct students how to prepare affinity chromatography columns to purify MSP, cloning and sequencing the polynucleotide that encodes an antibody and thus as a practicum for teaching a student how to design humanized antibodies. The MSP gene,s polypeptides or antibodies would then be packaged by reagent companies and sold to universities so that the students gain skill in art of molecular biology. Because each gene and protein is unique, each gene and protein creates unique challenges and learning experiences for students in a lab practicum. Such educational kits containing the MSP genes, polypeptides or antibodies are considered within the scope of the present invention.

The present invention also provides reagents for use in diagnostic and therapeutic applications. Such reagents include polynucleotide probes and primers; antibodies, including antibody fragments, single-chain antibodies, and other genetically engineered forms; soluble receptors and other polypeptide binding partners; and the proteins of the invention themselves, including fragments thereof. Those skilled in the art will recognize that diagnostic reagents will commonly be labeled to provide a detectable signal or other second function. Thus, polypeptides, antibodies, receptors, and other binding partners disclosed herein can be directly or indirectly conjugated to drugs, toxins, radionuclides, enzymes, enzyme substrates, cofactors, inhibitors, fluorescent markers, chemiluminescent markers, magnetic particles, and the like, and these conjugates used for in vivo diagnostic or therapeutic applications. Cytotoxic molecules, for example, can be directly or indirectly attached to the binding partner (e.g., by chemical coupling or as a fusion protein), and include bacterial or plant toxins (e.g., diphtheria toxin, Pseudomonas exotoxin, ricin, saporin, abrin, and the like); therapeutic radionuclides (e.g., iodine-131, rhenium-188 or yttrium-90) which can be directly attached to a polypeptide or antibody or indirectly attached through means of a chelating moiety; and cytotoxic drugs (e.g., adriamycin). Methods for preparing labeled reagents are known in the art. Within an alternative embodiment, the detectable signal or other function can be provided by a second member of a complement-anticomplement pair, which second member binds to the diagnostic reagent. For example, a first (unlabeled) antibody can be used to bind to a cell-surface polypeptide, after which a second, labeled antibody which binds to the first antibody is added. Other complement-anticomplement pairs are known in the art and include biotin/streptavidin.

Diagnostic reagents as disclosed herein can be used in vivo or in vitro. In vitro diagnostic assays include assays of tissue and fluid samples. Assays for protein in serum, for example, may be used to detect metabolic abnormalities characterized by over- or under-production of the protein, such as cancers, immune system abnormalities, infections, organ failure, metabolic imbalances, inborn errors of metabolism and other disease states. Proteins of the present invention can also be used in the detection of circulating autoantibodies, which are indicative of autoimmune disorders. Those skilled in the art will recognize that conditions related to protein underexpression or overexpression may be amenable to treatment by therapeutic manipulation of the relevant protein level(s). Proteins in serum can be quantitated by known methods known in the art, which include the use of antibodies in a variety of formats. Non-antibody binding partners, such as ligand-binding receptor fragments (commonly referred to as "soluble receptors") can also be used.

In general, diagnostic methods employing oligonucleotide probes or primers comprise the steps of (a) obtaining a genetic sample from a patient; (b) incubating the genetic sample with an oligonucleotide probe or primer as disclosed above, under conditions wherein the probe or primer will hybridize to a complementary polynucleotide sequence, to produce a first reaction product; and (c) comparing the first reaction product to a control reaction product. A difference between the first reaction product and the control reaction product is indicative of a genetic abnormality in the patient. Genetic samples for use within such methods include genomic DNA, cDNA, and RNA. Suitable assay methods in this regard include molecular genetic techniques known to those in the art, such as restriction fragment length polymorphism (RFLP) analysis, short tandem repeat (STR) analysis employing PCR techniques, ligation chain reaction (Barany, *PCR Methods and Applications* 1:5–16, 1991), ribonuclease protection assays, and other genetic linkage analysis techniques known in the art (Sambrook et al., ibid.; Ausubel et. al., ibid.; A. J. Marian, *Chest* 108:255–65, 1995). Ribonuclease protection assays (see, e.g., Ausubel et al., ibid., ch. 4) comprise the hybridization of an RNA probe to a patient RNA sample, after which the reaction product (RNA-RNA hybrid) is exposed to RNase. Hybridized regions of the RNA are protected from digestion. Within PCR assays, a patient genetic Sample is incubated with a pair of oligonucleotide primers, and the region between the primers is amplified and recovered. Changes in size, amount, or sequence of recovered product are indicative of mutations in the patient. Another PCR-based technique that can be employed is single strand conformational polymorphism (SSCP) analysis (Hayashi, *PCR Methods and Applications* 1:34–38, 1991). ). Chromosomal localization data can be used to correlate AFP gene locations with known genetic disorders using, for example, the OMIM™ Database, Johns Hopkins University, 2000.

Table 8 show the chromosomal localization of the polynucleotide sequences encoding some of the polypeptides described herein.

TABLE 8

| Protein | Chromosomal Localization |
|---|---|
| Z125G9P | 17p12 |
| Z281G1P | 22 |
| Z287G9P | 18q22.1 |
| Z577G9P | 4p15.1 |
| Z1055G2P | yp11.2 |
| Z1183G7P | 12q |
| Z1345G3P | 22q12.2 |
| Z1659G4P | 6q26–q27 |
| Z2007G2P | 7q21.3 |
| Z2972G5P | 3q27.3 |
| Z3038G1P | 17q12 |
| Z3264G1P | 8p11.23 |
| Z3357G2P | 7q31.1 |
| Z25999G1P | 22 |
| Z700497G2P | 11q22.1 |
| Z700823G2P | Xq24 |
| Z702408G2P | 19 |
| Z793561G4P | 16q24.1 |
| Z807166G2P | 16q12.1 |
| Z809335G4P | 15q15.3 |
| Z835892G6P | 14 |
| Z835999G1P | 15q22.32 |
| Z836222G4P | 6q15–16.3 |
| Z836325G9P | 18q23 |
| Z836355G5P | 20q13.2–13.33 |
| Z837892G2P | 14 |
| Z838468G2P | 8q22.3 |
| Z842039G5P | 10q21.3 |
| Z842046G1P | 4 |
| Z846090G4P | 2q32.2 |
| Z846280G2P | 8q12.1 |
| Z846631G3P | 1p36.11–36.23 |
| Z846626G9P | 8q24.3 |
| Z849135G16P | 20 |
| Z849213G14P | 12q23.3 |
| Z849559G5P | 10q26.3 |
| Z849746G1P | 11q24.3 |
| Z855073G14P | 15q15 |
| Z855260G4P | 2q34 |
| Z869105G16P | 6q26 |
| Z869173G14P | 5p15.32 |
| Z869654G5P | 5q11.2 |
| Z869719G6P | 6q14.3–16.1 |
| Z873683G5P | 5q14.3 |
| Z873745G3P | 6q27 |
| Z874015G4P | 18p11.32 |
| Z874090G3P | 8p21.3 |
| Z874090G4P | 8p21.3 |
| Z874178G8P | 11p12 |
| Z874193G6P | 6q21 |
| Z877091G9P | 7q36.3 |
| Z877532G7P | 5p14.1 |
| Z877975G4P | 15q11.2 |
| Z887014G7P | 8p23.3 |
| Z887280G5P | 14q24.1 |
| Z888627G9P | 7q36.3 |
| Z888644G7P | 15q15.3 |
| Z890990G20P | 3q26.2 |
| Z891399G5P | 16q22.2 |
| Z891575G17P | 17p12 |
| Z891682G2P | 4q31.1 |
| Z892025G7P | 8q21.3 |
| Z892026G1P | 10q22.1 |
| Z908225G14P | Xq26.3–27.3 |
| Z908460G2P | 14 |
| Z908593G16P | 10p15.1 |
| Z908644G15P | 1p22.2–31.1 |
| Z909165G15P | 13q13.3 |
| Z909204G1P | 9p24.2 |
| Z909460G4P | 5q15 |
| Z930798G6P | 20q12 |
| Z930898G2P | 20 |
| Z931019G10P | 18q11.2 |
| Z931363G4P | 17 |

TABLE 8-continued

| Protein | Chromosomal Localization |
|---|---|
| Z935148G9P | 17p11.2 |
| Z935205G2P | 3q26.1 |
| Z935553G3P | Xp22.32 |

Polynucleotides of the present invention, including fragments thereof, can also be used for radiation hybrid mapping, a somatic cell genetic technique developed for constructing high-resolution, contiguous maps of mammalian chromosomes (Cox et al., *Science* 250:245–50, 1990). Partial or full knowledge of a gene's sequence allows the design of PCR primers suitable for use with chromosomal radiation hybrid mapping panels. Commercially available radiation hybrid mapping panels which cover the entire human genome, such as the Stanford G3 RH Panel and the GeneBridge 4 RH Panel (Research Genetics, Inc., Huntsville, Ala.), are available. These panels enable rapid, PCR-based chromosomal localizations and ordering of genes, sequence-tagged sites (STSs), and other nonpolymorphic and polymorphic markers within a region of interest, allowing the establishment of directly proportional physical distances between newly discovered genes of interest and previously mapped markers. The precise knowledge of a gene's position can be useful for a number of purposes, including: 1) determining if a sequence is part of an existing contig and obtaining additional surrounding genetic sequences in various forms, such as YACs, BACs or cDNA clones; 2) providing a possible candidate gene for an inheritable disease which shows linkage to the same chromosomal region; and 3) cross-referencing model organisms, such as mouse, which may aid in determining what function a particular gene might have.

If a mammal has an insufficiency of a protein of interest (due to, for example, a mutated or absent gene), the corresponding wild-type gene can be introduced into the cells of the mammal. In one embodiment, a gene encoding a protein of interest is introduced into the animal using a viral vector. Such vectors include an attenuated or defective DNA virus, such as, but not limited to, herpes simplex virus (HSV), papillomavirus, Epstein Barr virus (EBV), adenovirus, adeno-associated virus (AAV), and the like. Defective viruses, which entirely or almost entirely lack viral genes, are preferred. A defective virus is not infective after introduction into a cell. Use of defective viral vectors allows for administration to cells in a specific, localized area, without concern that the vector can infect other cells. Examples of particular vectors include, but are not limited to, a defective herpes simplex virus 1 (HSV1) vector (Kaplitt et al., *Molec. Cell. Neurosci.* 2:320–30, 1991); an attenuated adenovirus vector, such as the vector described by Stratford-Perricaudet et al. (*J. Clin. Invest.* 90:626–30, 1992); and a defective adeno-associated virus vector (Samulski et al., *J. Virol.* 61:3096–101, 1987; Samulski et al., *J. Virol.* 63:3822–28, 1989).

Within another embodiment, a gene of interest is introducted into an animal by liposome-mediated transfection ("lipofection") essentially as disclosed above. Lipofection can be used to introduce exogenous genes into specific organs.

A gene of interest can also be introduced into an animal for gene therapy as a naked DNA plasmid using the methods disclosed above.

In another embodiment, polypeptide-.toxin fusion proteins or antibody/fragment-toxin fusion proteins may be used for targeted cell or tissue inhibition or ablation, such as in cancer therapy. Of particular interest in this regard are conjugates of an MSP protein and a cytotoxin, which can be used to target the cytotoxin to a tumor or other tissue that is undergoing undesired angiogenesis or neovascularization.

In another embodiment, MSP-cytokine fusion proteins or antibody/fragment-cytokine fusion proteins may be used for enhancing in vitro cytotoxicity (for instance, that mediated by monoclonal antibodies against tumor targets) and for enhancing in vivo killing of target tissues (for example, blood and bone marrow cancers). See, generally, Hornick et al., *Blood* 89:4437–4447, 1997). In general, cytokines are toxic if administered systemically. The described fusion proteins enable targeting of a cytokine to a desired site of action, such as a cell having binding sites for an MSP protein, thereby providing an elevated local concentration of cytokine. Polypeptides, antibodies, or receptors target an undesirable cell or tissue (e.g., a tumor), and the fused cytokine mediates improved target cell lysis by effector cells. Suitable cytokines for this purpose include, for example, interleukin-2 and granulocyte-macrophage colony-stimulating factor (GM-CSF).

In another embodiment, polypeptide-toxin fusion proteins or other binding partner-linked toxins may be used for targeted cell or tissue inhibition or ablation (for instance, to treat cancer cells or tissues). Target cells (i.e., those displaying a receptor for a polypeptide of interest) bind the polypeptide-toxin conjugate, which is then internalized, killing the cell. The effects of receptor-specific cell killing (target ablation) are revealed by changes in whole animal physiology or through histological examination. Thus, ligand-dependent, receptor-directed cyotoxicity can be used to enhance understanding of the physiological significance of a protein ligand. A preferred such toxin is saporin. Mammalian cells have no receptor for saporin, which is non-toxic when it remains extracellular. Alternatively, if the polypeptide of interest has multiple functional domains (i.e., an activation domain or a ligand binding domain, plus a targeting domain), a fusion protein including only the targeting domain may be suitable for directing a detectable molecule, a cytotoxic molecule or a complementary molecule to a cell or tissue type of interest. In instances where the domain-only fusion protein includes a complementary molecule, the anti-complementary molecule can be conjugated to a detectable or cytotoxic molecule. Such domain-complementary molecule fusion proteins thus represent a generic targeting vehicle for cell- or tissue-specific delivery of generic anti-complementary-detectable/cytotoxic molecule conjugates.

The bioactive conjugates described herein can be delivered intravenously, intraarterially or intraductally, or may be introduced locally at the intended site of action.

For pharmaceutical use, the proteins of the present invention are formulated according to conventional methods. Routes of delivery include topical, mucosal, and parenteral, the latter including intravenous and subcutaneous delivery. Intravenous administration will be by bolus injection or infusion over a typical period of one to several hours. In general, pharmaceutical formulations will include a protein of the present invention in combination with a pharmaceutically acceptable vehicle, such as saline, buffered saline, 5% dextrose in water or the like. Formulations may further include one or more excipients, diluents, fillers, emulsifiers, preservatives, solubilizers, buffering agents, wetting agents, stabilizers, colorings, penetration enhancers, albumin to prevent protein loss on vial surfaces, etc. Topical formulations are typically provided as liquids, ointments, salves, gels, emulsions and the like. Methods of formulation are well known in the art and are disclosed, for example, in *Remington: The Science and Practice of Pharmacy*, Gennaro, ed., Mack Publishing Co., Easton, Pa., 19th ed., 1995. Therapeutic doses will be determined by the clinician according to accepted standards, taking into account the nature and severity of the condition to be treated, patient traits, etc. Proteins of the present invention will generally be formulated to provide a dose of from 0.01 μg to 100 mg per kg patient weight per day, more commonly from 0.1 μg to 10 mg/kg/day, still more commonly from 0.1 μg to 1.0 mg/kg/day. Determination of dose is within the level of ordinary skill in the art. The proteins may be administered for acute treatment, over one week or less, often over a period of one to three days or may be used in chronic treatment, over several months or years. In general, a therapeutically effective amount is an amount sufficient to produce a clinically significant change in the targeted condition.

Within the laboratory research field, the proteins of the present invention can be used as molecular weight standards, or as standards in the analysis of cell phenotype, and as reagents for the study of cells, receptors, and other binding molecules. Such reagents will generally further comprise a second moiety, such as a label, binding partner, or toxin, that facilitates the detection of the protein when bound to its target. Many such systems are known in the art and are summarized above. Receptors and other cell-surface binding sites for proteins of the present invention can be identified by exposing a population of cells to a labeled protein under physiologic conditions, whereby the protein binds to the surface of the cell. Cells bearing receptors for a protein of interest can also be identified using the protein joined to a toxin, whereby receptor-bearing cells are killed by the toxin.

MSFP proteins and antagonists thereof can be used as standards in assays of protein and protein inhibitors in both clinical and research settings. Such assays can comprise any of a number of standard formats, include radioreceptor assays and ELISAs. Protein standards can be prepared in labeled form using a radioisotope, enzyme, fluorophore, or other compound that produces a detectable signal. The proteins can be packaged in kit form, such kits comprising one or more vials containing the MSP protein and, optionally, a diluent, an antibody, a labeled binding protein, etc. Assay kits can be used in the research laboratory to detect protein and inhibitor activities produced by cultured cells or test animals.

Proteins of the present invention may also be used as protein and amino acid supplements, including hydrolysates. Specific uses in this regard include use as animal feed supplements and as cell culture components. Proteins rich in a particular amino acid can be used as a source of that amino acid.

The invention is further illustrated by the following non-limiting examples.

EXAMPLES

Example 1

A protein of the present invention ("MSP") is produced in *E. coli* using a $His_6$ tag/maltose binding protein (MBP) double affinity fusion system as generally disclosed by Pryor and Leiting, *Prot. Expr. Pur.* 10:309–319, 1997. A thrombin cleavage site is placed at the junction between the affinity tag and MSP sequences.

The fusion construct is assembled in the vector pTAP98, which comprises sequences for replication and selection in *E. coli* and yeast, the *E. coli* tac promoter, and a unique SmaI site just downstream of the MBP-$His_6$-thrombin site coding sequences. The MSP cDNA is amplified by PCR using primers each comprising 40 bp of sequence homologous to vector sequence and 25 bp of sequence that anneals to the cDNA. The reaction is run using Taq DNA polymerase (Boehringer Mannheim, Indianapolis, Ind.) for 30 cycles of 94° C., 30 seconds; 60° C., 60 seconds; and 72° C., 60 seconds. One microgram of the resulting fragment is mixed with 100 ng of SmaI-cut pTAP98, and the mixture is transformed into yeast to assemble the vector by homologous recombination (Oldenburg et al., *Nucl. Acids. Res.* 25:451–452, 1997). $Ura^+$ transformants are selected.

Plasmid DNA is prepared from yeast transformants and transformed into *E. coli* MC1061. Pooled plasmid DNA is then prepared from the MC1061 transformants by the miniprep method after scraping an entire plate. Plasmid DNA is analyzed by restriction digestion.

*E. coli* strain BL21 is used for expression of MSP. Cells are transformed by electroporation and grown on minimal glucose plates containing casamino acids and ampicillin.

Protein expression is analyzed by gel electrophoresis. Cells are grown in liquid glucose media containing casamino acids and ampicillin. After one hour at 37° C., IPTG is added to a final concentration of 1 mM, and the cells are grown for an additional 2–3 hours at 37° C. Cells are disrupted using glass beads, and extracts are prepared.

Example 2

Larger scale cultures of MSP transformants are prepared by the method of Pryor and Leiting (ibid.). 100-ml cultures in minimal glucose media containing casamino acids and 100 μg/ml ampicillin are grown at 37° C. in 500-ml baffled flasks to $OD_{600}$=0.5. Cells are harvested by centrifugation and resuspended in 100 ml of the same media at room temperature. After 15 minutes, IPTG is added to 0.5 mM, and cultures are incubated at room temperature (ca. 22.5° C.) for 16 to 20 hours with shaking at 125 rpm. The culture is harvested by centrifugation, and cell pellets are stored at −70° C.

Example 3

For larger-scale protein preparation, 500-ml cultures of *E. coli* BL21 expressing the MSP-MBP-$His_6$ fusion protein are prepared essentially as disclosed in Example 2. Cell pellets are resuspended in 100 ml of binding buffer (20 mM Tris, pH 7.58, 100 mM NaCl, 20 mM $NaH_2PO_4$, 0.4 mM 4-(2-Aminoethyl)-benzenesulfonyl fluoride hydrochloride [Pefabloc® SC; Boehringer-Mannheim], 2 μg/ml Leupeptin, 2 μg/ml Aprotinin). The cells are lysed in a French press at 30,000 psi, and the lysate is centrifuged at 18,000×g for 45 minutes at 4° C. to clarify it. Protein concentration is estimated by gel electrophoresis with a BSA standard.

Recombinant MSP fusion protein is purified from the lysate by affinity chromatography. Immobilized cobalt resin (Talon® resin; Clontech Laboratories, Inc., Palo Alto, Calif.) is equilibrated in binding buffer. One ml of packed resin per 50 mg protein is combined with the clarified supernatant in a tube, and the tube is capped and sealed, then placed on a rocker overnight at 4° C. The resin is then pelleted by centrifugation at 4° C. and washed three times with binding buffer. Protein is eluted with binding buffer containing 0.2 M imidazole. The resin and elution buffer are mixed for at least one hour at 4° C., the resin is pelleted, and the supernatant is removed. An aliquot is analyzed by gel electrophoresis, and concentration is estimated. Amylose resin is equilibrated in amylose binding buffer (20 mM Tris-HCl, pH 7.0, 100 mM NaCl, 10 mM EDTA) and combined with the supernatant from the Talon resin at a ratio of 2 mg fusion protein per ml of resin. Binding and washing steps are carried out as disclosed above. Protein is eluted with amylose binding buffer containing 10 mM maltose using as small a volume as possible to minimize the need for subsequent concentration. The eluted protein is analyzed by gel electrophoresis and staining with Coomassie blue using a BSA standard, and by Western blotting using an anti-MBP antibody.

Example 4

An expression plasmid containing all or part of a polynucleotide encoding MSP is constructed via homologous recombination. An MSP coding sequence comprising the ORF with 5' and 3' ends corresponding to the vector sequences flanking the insertion point is prepared by PCR. The primers for PCR each include from 5' to 3' end: 40 bp of flanking sequence from the vector and 17 bp corresponding to the amino or carboxyl termini from the open reading frame of MSP.

Ten µl of the 100 µl PCR reaction mixture is run on a 0.8% low-melting-temperature agarose (SeaPlaque GTG®; FMC BioProducts, Rockland, Me.) gel with 1 × TBE buffer for analysis. The remaining 90 µl of the reaction mixture is precipitated with the addition of 5 µl 1 M NaCl and 250 µl of absolute ethanol. The plasmid pZMP6, which has been cut with SmaI, is used for recombination with the PCR fragment. Plamid pZMP6 is a mammalian expression vector containing an expression cassette having the cytomegalovirus immediate early promoter, multiple restriction sites for insertion of coding sequences, a stop codon, and a human growth hormone terminator; an E. coli origin of replication; a mammalian selectable marker expression unit comprising an SV40 promoter, enhancer and origin of replication, a DHFR gene, and the SV40 terminator; and URA3 and CEN-ARS sequences required for selection and replication in S. cerevisiae. It was constructed from pZP9 (deposited at the American Type Culture Collection, 10801 University Boulevard, Manassas, Va. 20110-2209, under Accession No. 98668) with the yeast genetic elements taken from pRS316 (available from the American Type Culture Collection, 10801 University Boulevard, Manassas, Va., under Accession No. 77145), an internal ribosome entry site (IRES) element from poliovirus, and the extracellular domain of CD8 truncated at the C-terminal end of the transmembrane domain.

One hundred microliters of competent yeast (S. cerevisiae) cells are independently combined with 10 µl of the various DNA mixtures from above and transferred to a 0.2-cm electroporation cuvette. The yeast/DNA mixtures are electropulsed using power supply (BioRad Laboratories, Hercules, Calif.) settings of 0.75 kV (5 kV/cm), ∞ ohms, 25 µF. To each cuvette is added 600 µl of 1.2 M sorbitol, and the yeast is plated in two 300-µl aliquots onto two URA-D plates (1.8% agar in 2% D-glucose, 0.67% yeast nitrogen base without amino acids, 0.056% -Ura -Trp -Thr powder [made by combining 4.0 g L-adenine, 3.0 g L-arginine, 5.0 g L-aspartic acid, 2.0 g L-histidine, 6.0 g L-isoleucine, 8.0 g L-leucine, 4.0 g L-lysine, 2.0 g L-methionine, 6.0 g L-phenylalanine, 5.0 g L-serine, 5.0 g L-tyrosine, and 6.0 g L-valine], and 0.5% 200X tryptophan, threonine solution [3.0% L-threonine, 0.8% L-tryptophan in $H_2O$]) and incubated at 30° C. After about 48 hours, the Ura$^+$ yeast transformants from a single plate are resuspended in 1 ml $H_2O$ and spun briefly to pellet the yeast cells. The cell pellet is resuspended in 1 ml of lysis buffer (2% Triton X-100, 1% SDS, 100 mM NaCl, 10 mM Tris, pH 8.0, 1 mM EDTA). Five hundred microliters of the lysis mixture is added to an Eppendorf tube containing 300 µl acid-washed glass beads and 200 µl phenol-chloroform, vortexed for 1 minute intervals two or three times, and spun for 5 minutes in an Eppendorf centrifuge at maximum speed. Three hundred microliters of the aqueous phase is transferred to a fresh tube, and the DNA is precipitated with 600 µl ethanol (EtOH), followed by centrifugation for 10 minutes at 4° C. The DNA pellet is resuspended in 10 µl $H_2O$.

Transformation of electrocompetent E. coli host cells (Electromax DH10B™ cells; obtained from Life Technologies, Inc., Gaithersburg, Md.) is done with 0.5–2 ml yeast DNA prep and 40 µl of cells. The cells are electropulsed at 1.7 kV, 25 µF, and 400 ohms. Following electroporation, 1 ml SOC (2% Bacto™ Tryptone (Difco, Detroit, Mich.), 0.5% yeast extract (Difco), 10 mM NaCl, 2.5 mM KCl, 10 mM $MgCl_2$, 10 mM $MgSO_4$, 20 mM glucose) is plated in 250-µl aliquots on four LB AMP plates (LB broth (Lennox), 1.8% Bacto™ Agar (Difco), 100 mg/L Ampicillin).

Individual clones harboring the correct expression construct for MSP are identified by restriction digest to verify the presence of the MSP insert and to confirm that the various DNA sequences have been joined correctly to one another. The inserts of positive clones are subjected to sequence analysis. Larger scale plasmid DNA is isolated using a commercially available kit (QIAGEN Plasmid Maxi Kit, Qiagen, Valencia, Calif.) according to manufacturer's instructions. The correct construct is designated pZMP6/MSP.

Recombinant protein is produced in BHK cells transfected with pZMP6/MSP. BHK 570 cells (ATCC CRL-10314) are plated in 10-cm tissue culture dishes and allowed to grow to approximately 50 to 70% confluence overnight at 37° C., 5% $CO_2$, in DMEM/FBS media (DMEM, Gibco/BRL High Glucose; Life Technologies), 5% fetal bovine serum (Hyclone, Logan, Utah), 1 mM L-glutamine (JRH Biosciences, Lenexa, Kans.), 1 mM sodium pyruvate (Life Technologies). The cells are then transfected with pZMP6/MSP by liposome-mediated transfection using a 3:1 (w/w) liposome formulation of the polycationic lipid 2,3-dioleyloxy-N-[2(sperminecarboxamido)ethyl]-N,N-dimethyl-1-propaniminium-trifluoroacetate and the neutral lipid dioleoyl phosphatidylethanolamine in membrane-filtered water (Lipofectamine™ Reagent; Life Technologies, Garithersburg, Md.), in serum free (SF) media (DMEM supplemented with 10 mg/ml transferrin, 5 mg/ml insulin, 2 mg/ml fetuin, 1% L-glutamine and 1% sodium pyruvate). The plasmid is diluted into 15-ml tubes to a total final volume of 640 µl with SF media. 35 µl of the lipid mixture is mixed with 605 µl of SF medium, and the resulting mixture is allowed to incubate approximately 30 minutes at room temperature. Five milliliters of SF media is then added to the DNA:lipid mixture. The cells are rinsed once with 5 ml of SF media, aspirated, and the DNA:lipid mixture is added. The cells are incubated at 37° C. for five hours, then 6.4 ml of DMEM/10% FBS, 1% PSN media is added to each plate. The plates are incubated at 37° C. overnight, and the DNA:lipid mixture is replaced with fresh 5% FBS/DMEM media the next day. On day 5 post-transfection, the cells are split into T-162 flasks in selection medium (DMEM+5% FBS, 1% L-Gln, 1% NaPyr, 1 µM methotrexate). Approximately 10 days post-transfection, two 150-mm culture dishes of methotrexate-resistant colonies from each transfection are trypsinized, and the cells are pooled and plated into a T-162 flask and transferred to large-scale culture.

From the foregoing, it will be appreciated that, although specific embodiments of the invention have been described herein for purposes of illustration, various modifications may be made without deviating from the spirit and scope of the invention. Accordingly, the invention is not limited except as by the appended claims.

SEQUENCE LISTING (329 sequences)

SEQ ID NO: 1 - DNA, 453 bp, Homo sapiens
  CDS (1)...(453)
atgctcttccctggcctcaccactaccctcctgctcctggttttcttcctgctggttttctccctgcctgctggcctacatacagccctcacagcagccagaggactccccaaactgcccaagcacagccacatcgccaaagacacccattcatccttcccatctcagctccaggggctgctttccaaagcaacaccacatagacatccctgtgatatagcacagttcaaaactgtgcgcattcaggagagccagcagcaggtggtcaccaagaggaaattccagcacttcacagccattcacaggcagggctcctatgtttatcaagacaataggcgcactactgaacatagaccctcatcagcggttttgcttttgccctttgccctgtttcctcagaagcatgtgatctttgttagacccttatcagtggttctgctttttgcactttga

SEQ ID NO: 2 - protein, 150 aa, Homo sapiens [sequence omitted]

SEQ ID NO: 3 - DNA, 303 bp, Homo sapiens
  CDS (1)...(303)
atggaaatccttcacaatgaaatctcagagctggaatctctcactctcgtccctcccctcatcttcttacttttacccagcagatctacccgtgggcagcccttttcccaagtaccaggggagaaaatggattcagaaaaggatttgtggggagaggagcttccacacttaatactgaaagaggcttttcatctgtttttcaagccaacagcagccccattcccagattcactcaaggtctcccttacatgtccctggaaagaaggagggtcacatacaagatgccagagtggcagcaggtga

SEQ ID NO: 4 - protein, 100 aa, Homo sapiens [sequence omitted]

SEQ ID NO: 5 - DNA, 276 bp, Homo sapiens
  CDS (1)...(276)
atgagtttgctgttgctgctgctgctgctgctgctgctgctgctgctgctgtttaaatggaaaagaagagtagtaagtggtcatcttctcagcgtctggtgctggtcccgcccacacactgtggcagagcagacccacctgttgtcactgggaaatgaggggctgcaggtactgcccttagacaatggaggtggccaaggacgtttggggacagattacaggaaagctcaacaattcccttcatgctttggtgttgagcactggcctcctttttaa

SEQ ID NO: 6 - protein, 91 aa, Homo sapiens [sequence omitted]

SEQ ID NO: 7 - DNA, 591 bp, Homo sapiens
  CDS (1)...(591)
atgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtcacggacgttgctgttctctgtgtctgtgacttatccccagcacagtgtgacatcaactgctgctgtgatcccgactgcagctccgtggatttcagtgtcttttctgcctgctcagttccagttgtcacacttactggagctctcccgtgtcagctcgtagcacagaaggtgaagagcctgctgtggggccagggcttcccagattacgtggccccttttggaaattcccaggcccaggacatgctggactggtgcccatccacttcatcacccagtcattcaacaggaaggtggtgtgatgaaggcagccggggaagccagctgttaaggaggcaggatggccctgagtgggagcgcgggctgaatcttggatactga

SEQ ID NO: 8 - protein, 196 aa, Homo sapiens
MRPRGLPPLLVVLLGCWASVSAQTDATPAVTTEGLNSTEAALATFGTFPSTRPPGTPRAPGPSSGPRPTPVTDVAVLCVCDLSPAQCDINCCCDPDCSSVDFSVFSACSVPVVTLTGALPCQLVAQKVKSLLWGQGFPDYVAPFGNSQAQDMLDWCPSTSSPSHSTGRWCDEGSRGSQLLRRQDGPEWERGLNLGY

SEQ ID NO: 9 - DNA, 1200 bp, Homo sapiens
  CDS (1)...(1200)
atggccagcctggggctgctgctcctgctcttactgacagcactgccaccgctgtggtcctcctcactgcctgggctggacactgctgaaagtaaagccaccattgcagacctgatcctgtctgcgctggagagagccaccgtcttcctagaacagaggctgcctgaaatcaacctggatggcatggtgggggtccgagtgctggaagccctgcgtgaatgctctcactcggatgttctcactcatgtctccccaatttctggccacctctggatcttcaccattgtctcccacctcaacaaagccactgctagcccacaggagcagctaaaaagtgtccgggagaagtgggcccaggagcccctgctgcagccgctgagcctgcgcgtggggatgctgggggagaagctggaggctgccatccagagatccctccactacctcaagctgagtgatcccaagtacctaagagagttccagctgaccctccagcccgggttttggaagctcccacatgcctggatccacactgatgcctccttggtgtaccccacgttcgggccccaggactcattctcagaggagagaagtgacgtgtgcctggtgcagctgctgggaaccgggacggacagcagcgagccctgcggcctctcagacctctgcaggagcctcatgaccaagcccggctgctcaggctactgcctgtcccaccaactgctcttcttcctctgggccagaatgagggggtgcacacagggaccactccaacagagccaggactatatcaacctcttctgcgccaacatgatggacttgaaccgcagagctgaggccatcggatacgcctaccctacccgggacatcttcatggaaaacatcatgttctgtggaatgggcggcttctccgacttctacaagctccggtggctggaggccattctcagctggcagaaacagcaggaaggatgcttcggggagcctgatgctgaagatgaagaattatctaaagctattcaatatcagcagcatttttcgaggagagtgaagaggcgagaaaaacaatttccagatggctgctcctcccacaacacagccacagcagtggcagccctgggtggcttcctatacatcctggcagaataccccccagcaaacagagagccacacccatccacaccgccaccaccaagcagccgctga

SEQ ID NO: 10 - protein, 399 aa, Homo sapiens
MASLGLLLLLLLTALPPLWSSSLPGLDTAESKATIADLILSALERATVFLEQRLPEINLDGMVGVRVLEALRECSHSDVLTHVSPISGHLWIFTIVSHLNKATASPQEQLKSVREKWAQEPLLQPLSLRVGMLGEKLEAAIQRSLHYLKLSDPKYLREFQLTLQPGFWKLPHAWIHTDASLVYPTFGPQDSFSEERSDVCLVQLLGTGTDSSEPCGLSDLCRSLMTKPGCSGYCLSHQLLFFLWARMRGCTQGPLQQSQDYINLFCANMMDLNRRAEAIGYAYPTRDIFMENIMFCGMGGFSDFYKLRWLEAILSWQKQQEGCFGEPDAEDEELSKAIQYQQHFSRRVKRREKQFPDGCSSHNTATAVAALGGFLYILAEYPPANREPHPSTPPPPSSR

SEQ ID NO: 11 - DNA, 243 bp, Homo sapiens
  CDS (1)...(243)
atggctgcccccaagggtcttctgctggttgctctagtcttgctacttgctgacagcttgcaggtgattagtgggaaagctcagtgtgtgactgctgtgactttggctattcccacacagagaaatgtggcaccaaggtgctttggggaggatgcacaagtggcagcctcctgcaagatgctgaaggactttttgctggttgcactggccttcactggtgtcactctgttgctgctcctgtga

SEQ ID NO: 12 - protein, 80 aa, Homo sapiens [sequence omitted]

SEQ ID NO: 13 - DNA, 555 bp, Homo sapiens
  CDS (1)...(555)
atgacccactacttcagagagacccaagaagagggctgttcaccctctctggatggcggtaccactgcccccgccctcctgctcctgctgctgctgctgctttttgcaggcacccccaccacccctgagtcaatccaagaaactgaggtcatcaacccaggaccgcctaggggccaaacttctccagatccctactggaagactctggatggcagggcctgggaacctggtcccactgaaaccaaggaactggaggacaacgaggtcatccccaggaggatctcactctctgcgggggaccaggatgtgtccaataaggcacccatgtccaacactgcccagggcagcaacatctttgagagaatggaggtcgtggcagtcctgattgtggacagcatcgcgggcatcctctctgctgttttcctgatcctgcttctggtgaaccatatgaagaaggatgaaggcagaaacgacctgagcaggaagcccatctacaaaaaagcccctagcaaggagttattacgcttcttctatgagcactggtttggactttag

SEQ ID NO: 14 - protein, 184 aa, Homo sapiens
MTHYFRETQEEGCSPSLDGGTTAPALLLLLLLLLFAGTPTTPESIQETEVINPGPPRGQTSPDPYWKTLDGRAWEPGPTETKELEDNEVIPRRISLSAGDQDVSNKAPMSNTAQGSNIFERMEVVAVLIVDSIAGILSAVFLILLLVNHMKKDEGRNDLSRKPIYKKAPSKELLRFFYEHWFGL

SEQ ID NO: 15 - DNA, 567 bp, Homo sapiens
  CDS (1)...(567)
atgcaggggtccgccctccctggcacctggctgcaggctttgctggtgtggctggcctgggccccggctgcctctgcctacagtgccatccacgctagggaacagctgtccccacaagaaccatgtggtccatgtctgggcagtgaccgcctcacttgcagccaaccccacactcttcagtggtgccgaggtcctgtggcagactcagccaatcccagtgtggacttgactcggtcttggacaccgggggccagtgagctagctgttgggccagtggggctcagcctgatactggacagagcctggacctggggcctgtggctggggaggggtgctcctgtgtgggccaacaggacggccgatggcctggaagacagtgtgaccgagctatcagctagcactcgggactccacatggatgcagaggtcaccgctggccatttcaggagacactacgcctaggagctactgcagccagcactgccaggcagcgacatcacaggaggacatttctaacaaaacaaaaagcatcttcccatcttcgtggacaactgccatgtggttctga

SEQ ID NO: 16 - protein, 188 aa, Homo sapiens [sequence omitted]

SEQ ID NO: 17 - DNA, 474 bp, Homo sapiens
  CDS (1)...(474)
atgcgattgtggttcaccgcagtcttgacctcctgggctcaagccatcctcccttcttggcctcccaatgtggtggtattacaggccgggcctccactttctcatgtcacccactctgctattactccatgctcccatccttcctacgtccttactttcacccaggatgagaaagtgccccaccgtgtccaggccacatcaccttgtcccatgacctatgtcccttccctccccaagggaagcttcagcccataccttgcgccatttacccggcccaagggctctccctgcgcaggaaaggccgacctcacactgcatgtggatggcgtgacagtcctgaatgtggggaaagagagcttgtcctcgcagctacgtcaacagaagccagagactggggccaagaagaaagaccctgcggggttgggctggaaagtcctggacgcccagctcttcacacccactcagtgcatgtga

SEQ ID NO: 18 - protein, 157 aa, Homo sapiens
MRLWFTAVLTSWAQAILPSWPPNVVVLQAGPPLSHVTHSAITPCSHPSYVLTFTQDEKVPHRVQATSPCPMTYVPSLPKGSFSPYLAPFTRPKGSPCAGKADLTLHVDGVTVLNVGKESLSSQLRQQKPETGAKKKDPAGLGWKVLDAQLFTPTQCM

SEQ ID NO: 19 - DNA, 495 bp, Homo sapiens
  CDS (1)...(495)
atgcaaaggtggacactgtgggctgcagccttcctgaccctccactctgcacaggcctttccacaaacagacatcagtatcagtccagccctgccagagctgcccctgccttccctgtgccccctgttctggatggagttcaaaggccactgctatcgattcttccctctcaataagacctgggctgaggccgacctctactgttctgagttctctgtgggcaggaagtccgccaagctggcctccatccacagctgggaggagaatgtctttgtatatgacctcgtgaacagctgtgttcccggcatcccagctgacgtctggacaggccttcatgatcacagacaggaagggcagtttgaatggactgatggctcatcctatgactacagctactgggatggcagccagccagatgatggcgtccacgcggacccagaagaagaggactgcgtgcagatatggtacaggcctaccagtggtgggtacccctga

SEQ ID NO: 20 - protein, 164 aa, Homo sapiens
MQRWTLWAAAFLTLHSAQAFPQTDISISPALPELPLPSLCPLFWMEFKGHCYRFFPLNKTWAEADLYCSEFSVGRKSAKLASIHSWEENVFVYDLVNSCVPGIPADVWTGLHDHRQEGQFEWTDGSSYDYSYWDGSQPDDGVHADPEEEDCVQIWYRPTSGGYP

SEQ ID NO: 21 - DNA, 531 bp, Homo sapiens
  CDS (1)...(531)
atgcccagggtgatggcctggaggtactgggtccacacagatggctgctgcagccaaccctgccagagtccccaaggtgccctagccatgctgccgcttgtgctagccttcatcagtgaaatctcagcccaaccaaaccagtttcagggtgccagctcagtgacattcatttccacacttttgttgaacccgaccttcactaagcactggctctgcaccaggagtgtgcggggccctggcatgcaggggccccaggccagccccagccctgctctggagcttatgatggaacttaaccagaagaagctaaggaagagaagagaggagaggagagagacagtgaagaggctggaaaaggaggaagagaagtatgttctttggaatcaaagtgttacctggattcctacccaggattttcctattgtctcaggacctaaagggaaaagaccggccatggggcataatggggacgatacaggacctccctcatcagagctgtcacaagtgaacctcaatttcctgattccctaa

SEQ ID NO: 22 - protein, 176 aa, Homo sapiens [sequence omitted]

SEQ ID NO: 23 - DNA, 282 bp, Homo sapiens
  CDS (1)...(282)
atggcccgatgtcccctccttctgtttcccctgccgcttgtccccatggccctgggggcatccgcaggagggaggcatgcttttgggtaccgacacatgttcctccaggaggagtggtggaaaggaggaatcctttggcctccaaccctggaagaagggtccatgtgggaggaaacagctcacaggtcatcaatgagacatcggagagagccgctaggtgttgtggcagatgaggcagtgcctccacgtgtgctcatgggcactcccggtcatgaagagtga

SEQ ID NO: 24 - protein, 93 aa, Homo sapiens
MARCPLLLFPLPLVPMALGASAGGRHAFGYRHMFLQEEWWKGGILWPPTLEEGSMWEETAHRSSMRHRREPLGVVADEAVPPRVLMGTPGHEE

SEQ ID NO: 25 - DNA, 372 bp, Homo sapiens
  CDS (1)...(372)
atgccccctgaccccaaggcactgctctgcctcaacctcccccacttcgccctgtgccagccctgggtaccctccctgcaggccgcgtccctcgccacctggcctcctgtcttctggaactcaggccctgccccctgctcccagcctccaatgcccacgtccaacaggactctgcttctcagccccacctcaccccacagccgtcactcaggccgcatcagtacccaaacgccccgccgccggcagccgtggggccccagggagtggcgggctggcagcggcactgagggcctggggttggtggcccagctggctcaggccgcctacaatgcgtgtggccctgccaaggaggcagacagccctgagccttag

SEQ ID NO: 26 - protein, 123 aa, Homo sapiens
MPPDPKALLCLNLPHFALCQPWVPSLQAASLATWPPVFWNSGPAPCSQPPMPTSNRTLLLSPTSPHSRHSGRISTQTPRRRQPWGPREWRAGSGTEGLGLVAQLAQAAYNACGPAKEADSPEP

SEQ ID NO: 27 - DNA, 657 bp, Homo sapiens
  CDS (1)...(657)
atggagacagagccttcaaaggccagagccaatgacccaggatcagctgcagaggggctcagcctgttgctgcttcccttgctcctggttcaagctggtgtctggggattcccaaggcccccagggaggccccagctgagcctgcaggagctgcggagggagttcacagtcagcctgcatctcgccaggaagctgctctccgaggttcggggccaggcccaccgctttgacccggagcgtctctgcttcatctccaccacgcttcagcccttccatgccctgctgggagggctggggacccagggccgctggaccaacatggagaggatgcagctgtgggccatgaggctggacctccgcgatctgcagcggcacctccgcttccaggtgctggctgcaggattcaacctcccggaggaggaggaggaggaagaggaggaggaggaggaggagaggaaggggctgctcccaggggcactgggcagcgccttacagggcccggcccaggtgtcctggccccagctcctctccacctaccgcctgctgcactccttggagctcgtcttatctcgggccgtgcgggagttgctgctgctgtccaaggctgggcactcagtctggcccttggggttcccaacattgagcccccagccctga

SEQ ID NO: 28 - protein, 218 aa, Homo sapiens
METEPSKARANDPGSAAEGLSLLLLPLLLVQAGVWGFPRPPGRPQLSLQELRREFTVSLHLARKLLSEVRGQAHRFDPERLCFISTTLQPFHALLGGLGTQGRWTNMERMQLWAMRLDLRDLQRHLRFQVLAAGFNLPEEEEEEEEEEEEERKGLLPGALGSALQGPAQVSWPQLLSTYRLLHSLELVLSRAVRELLLLSKAGHSVWPLGFPTLSPQP

SEQ ID NO: 29 - DNA, 533 bp, Homo sapiens
  CDS (1)...(533)
atgcacgttccagtgataaagctgtgcacggcagccatggctatccagctggcccagcccaacagagatctgtggttcctcacttgcctgcaccttctctgccttctcctcttaccatcacctccaatatcagcaggtcctggtccttctctgccttctcccctcaccatcatgtccaatatcagcagctgccagagcctggccccaccatcatcctctcccagctggacaggtgttcctgccttccaagtagggtcccagcctccacccttggaggtagacctacaggaactcttcggagaggacaagcgccttttaaaggtcgagcatctatgctgctgcggctacgtacctgtcacgagcatccaaccaatttggggcgcgcatctgctgtgcttaaagggcaagttcaacactgttaagtttgtgttgcaacgaagccagattgtgtgggcacaatccagtaccaggggtctgactactaacagtcgcatattacctcccttatacctcccgtgtatgctcctagcccg

SEQ ID NO: 30 - protein, 177 aa, Homo sapiens
MHVPVIKLCTAAMAIQLAQPNRDLWFLTCLHLLCLLLLPSPPISAGPGPSLPSPLTIMSNISSCQSLAPPSSSPSWTGVPAFQVGSQPPPLEVDLQELFGEDKRLLKVEHLCCCGYVPVTSIQPIWGAHLLCLKGKFNTVKFVLQRSQIVWAQSSTRGLTTNSRILPPLYLPCMLLA

SEQ ID NO: 31 - DNA, 525 bp, Homo sapiens
  CDS (1)...(525)
atgggagtctcactggatcaggagcacagcagacaccctgctggatctggaggtatgggagtcagcggcaggtctgcgacagtggcaaacagcagtggtggatggatctttggggtgttgcttttctcaccggaaacctctgcagccagtggcatctttgcccaagttcatgtcctgtgtccaggaagaatgaggtatgcagacaagtggaggagggaaggaagtgcatgccgattggtccataggcagccatgggctgctggaaaaggcaccacaagtccccactctggacagtggaatagcagcccaacccccagccttcaagacctccctggcctgaagaacagaaatttggctgctatgaaacttgacaagccgatccccagcccatcacttaggcacaatctctttgagattttaagagcgcgccagccatgcctgtacgcctgcaactcgaaactgcgcattcgaggaccagcagggcccctagagagcatgggcttgaggtgtcgttccccggagtga

SEQ ID NO: 32 - protein, 174 aa, Homo sapiens [sequence omitted]

SEQ ID NO: 33 - DNA, 369 bp, Homo sapiens
  CDS (1)...(369)
atgcgctccctgcataacgcgcggcacgcctccttcgctcaacttggccgtatgttgattgtcagcatcaacaagctcctaatgccacctttaaaagtgtctatatctcttttaagattattacctcctacatttgctgtgctctttgtatacaactcccgtttccgcgctgcttcttacatgcaacacctcaaatgtaacaaacaacccggtcccatgtctttacagaacgttggtcacatgaatctgccccaaccccagggcgctgctggcgccgatgccatcccgcaccaccttgcacaagtccgtagggttttgcgtctattagcactacgccctaacccatcggagtcattactggggttttag

SEQ ID NO: 34 - protein, 122 aa, Homo sapiens
MRSLHNARHASFAQLGRMLIVSINKLLMPPLKVSISLLRLLPPTFAVLFVYNSRFRAASYMQHLKCNKQPGPMSLQNVGHMNLPQPQGAAGADAIPHHLAQVRRVLRLLALRPNPSESLLGF

SEQ ID NO: 35 - DNA, 1148 bp, Homo sapiens
  CDS (1)...(1148)
atggagcccctgcgcgcgcccgcgctgcgccgcctgctgccgccgctgctgctcctgctgctgtcactgcccccccgcgcccgggccaagtacgtgcggggcaacctcagttccaaggaggactgggtgttcctgacaagattttgtttcctctcggattacggccgactggacttccgtttccgctaccctgaggccaagtgctgtcagaacatcctcctctattttgatgacccatcccagtggccagccgtgtacaaggcaggggacaaggactgcctggccaaggagtcagtgatccggccggagaacaaccaggtcatcaacctcaccacccagtatgcctggtccggctgtcaggtggtatcagaggagggaacccgctacctgagctgctccagtggccgcagcttccgctcagtgcgtgaacggtggtggtatattgcgctcagcaagtgtgggggtgatggattgcagctggagtatgagatggtcctcaccaatggcaagtccttctggacacgacacttctccgctgatgagtttgggatcctggagacagatgtgaccttcctcctcatcttcatcctcatcttcttcctctcttgttactttggatatttgctgaaaggtcgtcagttgctccacacaacttataaaatgttcatggccgcagcaggagtagaggtcctgagcctcctatttttctgcatctactggggtcaatatgccaccgatggcattggcaacgagagtgtgaagatcttggccaagctgctcttctcctccagcttcctcatcttcctgctgatgcttatcctcctggggaagggattcacggtgacacggtgcccgggcagggcgtgctcgtggggcggctggggccgcatcagccacgcgggctccgtgaagttgtctgtctacatgaccctgtacacgctcacccatgtggtgctgctcatctacgaggcggaattctttgacccaggccaggtactgtacacgtatgagtcgccggccggctacgggctcattggactgcaggtggcggcctacgtgtggttctgctatgctgtgcttgtctcactgcgacactttcctgagaagcagcctttttatgtgcccttctttgctgcctataccctctg

SEQ ID NO: 36 - protein, 382 aa, Homo sapiens
MEPLRAPALRRLLPPLLLLLLSLPPRARAKYVRGNLSSKEDWVFLTRFCFLSDYGRLDFRFRYPEAKCCQNILLYFDDPSQWPAVYKAGDKDCLAKESVIRPENNQVINLTTQYAWSGCQVVSEEGTRYLSCSSGRSFRSVRERWWYIALSKCGGDGLQLEYEMVLTNGKSFWTRHFSADEFGILETDVTFLLIFILIFFLSCYFGYLLKGRQLLHTTYKMFMAAAGVEVLSLLFFCIYWGQYATDGIGNESVKILAKLLFSSSFLIFLLMLILLGKGFTVTRCPGRACSWGGWGRISHAGSVKLSVYMTLYTLTHVVLLIYEAEFFDPGQVLYTYESPAGYGLIGLQVAAYVWFCYAVLVSLRHFPEKQPFYVPFFAAYTL

SEQ ID NO: 37 - DNA, 333 bp, Homo sapiens
  CDS (1)...(333)
atgtcggtggttgaggtgcaaggcctcgtgtgttatgcgaggcgtccgctgatacttcctctgctgctcttctggtcgttgagcgggtctagtcgtgctactgtcgctactggacggtcgcgtagtcgtcgtatagtgcgtcgtggacctcatggagatgatagctacgtgcttccgatcgtcgtagataaatggttgggccgttcactgaccgtcatcctcaagcacgggctacggcggctcgtcgaggacgataagcacccgcccctcctctggggatatgtggctccagtgtgggggggccccagtgacccatttgttgaaatgatataa

SEQ ID NO: 38 - protein, 110 aa, Homo sapiens
MSVVEVQGLVCYARRPLILPLLLFWSLSGSSRATVATGRSRSRRIVRRGPHGDDSYVLPIVVDKWLGRSLTVILKHGLRRLVEDDKHPPLLWGYVAPVWGGPSDPFVEMI

SEQ ID NO: 39 - DNA, 441 bp, Homo sapiens
  CDS (1)...(441)
ctgcagagctatagatccaactgccagctggacaaacccaactcatctccagccatggcccctcctgatggagcagcccttctgctgctgctgctgctgtttacggctgcttcaataaaaactgctaactccattggctcgcccttaccttctttcttgggtgaagccacaaaccctcctgggaggcatgtaaagcggtatggtcactttgaagagcagttgggtcacttcttaaaaagtgaaacctactatatgacccagtcattctgctcctatgcacctcctcaacagcaatgtggccagggtgcccaggatgagtgtgagaaggagggctgccatggttcccctgcagccacctctgactctcggcagtgggcagctaggacttccctcgaggggctggctgagctccttggtgctcaatgtcgtaccatttactga

SEQ ID NO: 40 - protein, 146 aa, Homo sapiens
LQSYRSNCQLDKPNSSPAMAPPDGAALLLLLLLFTAASIKTANSIGSPLPSFLGEATNPPGRHVKRYGHFEEQLGHFLKSETYYMTQSFCSYAPPQQQCGQGAQDECEKEGCHGSPAATSDSRQWAARTSLEGLAELLGAQCRTIY

SEQ ID NO: 41 - DNA, 441 bp, Homo sapiens
  CDS (1)...(441)
atgctgttgctgcagctgctgctgctgctgccgccgctgctgctcctgcttttttcagtctcactctgttgcccaggctggagtgaagtgggcatggaagtcaaaccaggtctcccttcccacaactcgctgccccagcccatggcagatggacatcccccaagggcattacaaccatggcacaaggacacccttggtccagagggaagttgcaaagtctggtttgcctggaaggagctcttccaggtggaggaagcggcagataaagaaactgaagttcagagtgtcagcttacccaaggtcacatctgaaaagcagcagagacaggtttcaacccagattgggctgactccaagccccatgctgattccctgtggcacctgcctctcggctggtacagaaaaccagggaaagctgtatttgaatctcaacccaatctga

SEQ ID NO: 42 - protein, 146 aa, Homo sapiens
MLLLQLLLLLPPLLLLLFSVSLCCPGWSEVGMEVKPGLPSHNSLPQPMADGHPPRALQPWHKDTLGPEGSCKVWFAWKELFQVEEAADKETEVQSVSLPKVTSEKQQRQVSTQIGLTPSPMLIPCGTCLSAGTENQGKLYLNLNPI

SEQ ID NO: 43 - DNA, 203 bp, Homo sapiens
  CDS (1)...(203)
atgactggctgtccggcgtcatcaagacgccgaggcttcgggctctttttcatcttgcgtctacaccgcctcctgttgttgtttctggttttgcgtgggaccctggccaacaaacttaacgtgccacaggtgttgctacccttcggccgagagccaggccgggtgcctttcctgctggaggcccagcggggctgctacacttg

SEQ ID NO: 44 - protein, 67 aa, Homo sapiens
MTGCPASSRRRGFGLFFILRLHRLLLLFLVLRGTLANKLNVPQVLLPFGREPGRVPFLLEAQRGCYT

SEQ ID NO: 45 - DNA, 441 bp, Homo sapiens
  CDS (1)...(441)
atggccctgtcttggctggccctgtcccccgggttacagggccagaacctgctggaagcagggcgcaggaccagccagatcccaccaggctccctgagggactatacagtgcctctgtgccgcctggagcccaggcccgccttctccgtggccgccctggccttgagggccaccagcctggctgcgcagggctatgaagaaggcatggaagacaaggataactcagggaacagagaagatggcagcacagatagtgtcacttggggttttgagaaaggcgatagatattggctgccactcagatcatgtgggataatgatgctagaacaggtttccaccttcattcatatgcaggaggactttgaccaggttctcacagtaaatatggaagaaaaatctcccctagcttctagcaggggaaaagaaaaggagaccacttag

SEQ ID NO: 46 - protein, 146 aa, Homo sapiens [sequence omitted]

SEQ ID NO: 47 - DNA, 384 bp, Homo sapiens
  CDS (1)...(384)
atggtaaagctgctgctctccctgctgtccacaactggggcctggagctggggtcacattttacaaccggagggttcttgggagctgtggttaccaggttctacagtggcacccactgatctacagtgggtgctccacccaggactgctcagtgagactaatacgctgccatcctttctactgggaactgtaacaacacggacttactgtgcatcgggcactgtgcagagacttgacattagcctccttcagccttggggctatgagaaaccttgtcccattctggctgagggtgctgaagtaggaaggcgtgttggaactactgagagcagagaactcaacacacacaaagaatccaaaatttgcttttactcggagtcctga

SEQ ID NO: 48 - protein, 127 aa, Homo sapiens [sequence omitted]

SEQ ID NO: 49 - DNA, 1110 bp, Homo sapiens
  CDS (1)...(1110)
atgccacccatgctgtggctgctgctccactttgctgccccggcactggggttctacttttccatcagctgccccagtggtaagcagtgccaacaggccctactctcaggcaatgatattctcctgtattgcaactcctcgggggcgcactggtactatttattcacacaaggcaagaagggcaggctcaccagcctcaccaatatttccaatatggaaataatgcccgagggcagccttctcattaaagatccattgccctcccagacgggcctctaccactgctggaacaagaatggccgccaagtggtgcagtatgaaattgactttcaggatgtcaccaccctgcatataacacacaaggacctgggtcagaggcccctgcagaacgagaccctgcatttgggcagcaaacagctcatttttacctggtgggagccctggcaggactgcaaccgctgtgaggagccgggcgagtgtaaacgcctggggtaccgctacattgaggagcctctggaggaagccatgccctgctggctctatctgggagaggtgctggtgtggtctagccgcttgcggcctgagctgcaggtggaagcctgccacgtccagtgcaccaataacacacagttaagggtggattacgtcatttttgacaacttcaggctcgatgagaagacagaatttgtgtggctcgactgtcccttaggatccatgtacaggcccgtcaactggcgtgccaacgacacccccctgacgtgggagagccagctctccggccaggacttcaccacctttctggacccctccaccggcggcaggcagctgcaggttttccagccggccgtctacaagtgcttcgtgcagcaggagctcgtggcccagttcaaacccgccgccagtctggagacgctggaggctcagtggagagagaacgatgcccagtggcgggaggcaaggaaggccctgcggggcagggcggactccgtgctcaaggggctgaagctggtgctgctcgtggtcaccgtcctggccctgctgggggcgctgctcaagtgcatccacccttccccgggcaggagaagcacacaggtgctggtggtgaaataa

SEQ ID NO: 50 - protein, 369 aa, Homo sapiens
MPPMLWLLLHFAAPALGFYFSISCPSGKQCQQALLSGNDILLYCNSSGAHWYYLFTQGKKGRLTSLTNISNMEIMPEGSLLIKDPLPSQTGLYHCWNKNGRQVVQYEIDFQDVTTLHITHKDLGQRPLQNETLHLGSKQLIFTWWEPWQDCNRCEEPGECKRLGYRYIEEPLEEAMPCWLYLGEVLVWSSRLRPELQVEACHVQCTNNTQLRVDYVIFDNFRLDEKTEFVWLDCPLGSMYRPVNWRANDTPLTWESQLSGQDFTTFLDPSTGGRQLQVFQPAVYKCFVQQELVAQFKPAASLETLEAQWRENDAQWREARKALRGRADSVLKGLKLVLLVVTVLALLGALLKCIHPSPGRRSTQVLVVK

SEQ ID NO: 51 - DNA, 759 bp, Homo sapiens
  CDS (1)...(759)
atggcagcccccgccctgctgctcctagcactgctgctgcccgtgggggcctggcccgggctgcccaggaggccctgtgtgcactgctgccgcccggcctggccccctggaccctatgcccgggtgagtgacagggacctgtggaggggggacctgtggagggggctgcctcgagtacggcccactatagacatcgaaatcctcaaaggtgagaagggtgaggccggcgtccgaggtcgggccggcaggagcgggaaagaggggccgccaggcgcccggggcctgcagggccgcagaggccagaaggggcaggtggggccgccgggcgccgcgtgccgacgtgcctacgccgccttctccgtgggccggcgcgagggcctgcacagctccgaccacttccaggcggtgcccttcgacacggagctggtgaacctggacggcgccttcgacctggccgcgggccgcttcctctgcacggtgcccggcgtctacttcctcagcctcaacgtgcacacctggaactacaaggagacctacctgcacatcatgctgaaccggcggcccgcggccgtgctctacgcgcagcccagcgagcgcagcgtcatgcaggcccagagcctgatgctgctgctggcggcgggcgacgccgtctgggtgcgcatgttccagcgcgaccgggacaacgccatctacggcgagcacggagacctctacatcaccttcagcggccacctggtcaagccggccgccgagctgtag

SEQ ID NO: 52 - protein, 252 aa, Homo sapiens
MAAPALLLLALLLPVGAWPGLPRRPCVHCCRPAWPPGPYARVSDRDLWRGDLWRGLPRVRPTIDIEILKGEKGEAGVRGRAGRSGKEGPPGARGLQGRRGQKGQVGPPGAACRRAYAAFSVGRREGLHSSDHFQAVPFDTELVNLDGAFDLAAGRFLCTVPGVYFLSLNVHTWNYKETYLHIMLNRRPAAVLYAQPSERSVMQAQSLMLLLAAGDAVWVRMFQRDRDNAIYGEHGDLYITFSGHLVKPAAEL

SEQ ID NO: 53 - DNA, 293 bp, Homo sapiens
  CDS (1)...(293)
atgcaggccccctcgctcctcagcgtggtggccgtctggctgacctgggccaatggggccatcaaccctgtcatctacgccatccgcaatcccaacatttcgatgctcctagggcgcaaccgcgaggagggctaccggactaggaatgtggacgctttcctgcccagccagggcccgggtctgcaagccagaagccgcagtcgccttcgaaaccgctatgccaaccggctgggggcctgcaacaggatgtcctcttccaacccggccagcggagtggcaggggacgtggccat

SEQ ID NO: 54 - protein, 97 aa, Homo sapiens
MQAPSLLSVVAVWLTWANGAINPVIYAIRNPNISMLLGRNREEGYRTRNVDAFLPSQGPGLQARSRSRLRNRYANRLGACNRMSSSNPASGVAGDVA

SEQ ID NO: 55 - DNA, 258 bp, Homo sapiens
  CDS (1)...(258)
atgtcaccgccgccgccgctgctgctgctgctgctgctgagtctggcgctgctgggcgcccgggcccgcgccgagcccgccgggagtgccgtccccgcgcagagccgcccatgcgtggactgccacgccttcgagttcatgcagcgcgccctgcaggacctgcggaagacagcctgcagcctggacgcgcggacggagaccctactgctgcaggcagagcgccgtgccctgtgtgcctgctggccagcggggcactga

SEQ ID NO: 56 - protein, 85 aa, Homo sapiens [sequence omitted]

SEQ ID NO: 57 - DNA, 570 bp, Homo sapiens
  CDS (1)...(570)
atggaggaacaagccacacagggggttccaaagtctccaggggatgctgaggaagccttccttgccctgtcctgggtcttggccagcggtgggctccccagggacctcaccaggacggcattttgcgagagccgaagccggaagcggcctcggggtgcgctgcaccgcctcttccggggcctctctaggccggagcgcgggatttcggtggccgggagaggccggaacggcttcgcggggcagcggcgcctcctggcgggcctggggtcaggcagtccgtggggggtctggctggctccctgcagtacacacctgcgccgatgcccagcgttgaggccctacccatcccgggggacctttcccctcccgcctcccgcccttctgtcggctttcttcccacggatctgccaggaagccttccaggactgtcctggagcatcaaggctcgaccgcacggccatgggtaccgaccatcccagccacacggctgggcaacgtgtggtgggtcaccgcgcagccagactccggctggtgaccgccaggggtcagcagaggcctccttttgcatag

SEQ ID NO: 58 - protein, 189 aa, Homo sapiens
MEEQATQGVPKSPGDAEEAFLALSWVLASGGLPRDLTRTAFCESRSRKRPRGALHRLFRGLSRPERGISVAGRGRNGFAGQRRLLAGLGSGSPWGVWLAPCSTHLRRCPALRPYPSRGTFPLPPPALLSAFFPRICQEAFQDCPGASRLDRTAMGTDHPSHTAGQRVVGHRAARLRLVTARGQQRPPFA

SEQ ID NO: 59 - DNA, 498 bp, Homo sapiens
  CDS (1)...(498)
atgagaaagatacttttcctaaacctgtggatctcactagtgaaagcaagcacataccagggagaacaggaagccagaggcaccaacaacactgagtttgatgcaaaaaagggggactttagttcaggctgcataaaaacaggaggccgattcaatgcatggataaacgggtctgtctacctccatcgccgctcgtcaagtgcaatgggaaccgatgaaacactgaaggcctctgggctggcgtcaaccgaagagacaccggccaagcacagtgaccgcaaccggctggaacaaaccccacgggacccagagtgggaccaggcctgggggcgcaaggaggcccggctgccatccgtcgcatgcgcaaaggaggggctcacccaacaaacgatatgcagcgccgcggtttctgcgccgctggtccccacggtggagtcacacacgcagtccgttgaccctgtaaagggaaaaagaaggtcccaaatagcatcagaataa

SEQ ID NO: 60 - protein, 165 aa, Homo sapiens [sequence omitted]

SEQ ID NO: 61 - DNA, 462 bp, Homo sapiens
  CDS (1)...(462)
atgcacctgcggctgctaccactactgcttctgctaatgctgtcgttaaaactgatggctaccacgcgtggtcgattatgtgctacgtcttgtgcaagactccaagttcttcagtgtcgaactcttggacttacaccagtggtttgccagcggctctcgagccttctgctacagactgaaggctacgctctcggcttccctacttttagggctttgggacttgaactggcttccttgctcctcagcttgcagatggcctattgtgggactttaccttgtgatcataatgctacgctgtcacctgcaggaaagcctgagcagataaagatggcttctgcacctggaggaaatgggaatttccagcgagacaggaagaaaatgattcaaaatttgaaagctataagtgaccacattattcccactgcatatgaagaaattgatgcacaggaaataaacgtttga

SEQ ID NO: 62 - protein, 153 aa, Homo sapiens
MHLRLLPLLLLLMLSLKLMATTRGRLCATSCARLQVLQCRTLGLTPVVCQRLSSLLLQTEGYALGFPTFRALGLELASLLLSLQMAYCGTLPCDHNATLSPAGKPEQIKMASAPGGNGNFQRDRKKMIQNLKAISDHIIPTAYEEIDAQEINV

SEQ ID NO: 63 - DNA, 315 bp, Homo sapiens
  CDS (1)...(315)
atgaaggttggaggactcagcaagacagctttttcttctaccttcttctccctgctttttccagcctcactggcagctgattggatggtgcccaccacattgtggacattagaactaaagtttcttgggcctttagacttgagggcttacatcagtggcccccaatttctcaaactttcaacttcaaataaagttacatcctcagatcccccaggttcttctttggactcagactggattacatcaaaagctttcctggttcttcagtttgaagacagcatgttgtgggacttctcaacctctataattgtgtga

SEQ ID NO: 64 - protein, 104 aa, Homo sapiens
MKVGGLSKTAFSSTFFSLLFPASLAADWMVPTTLWTLELKFLGPLDLRAYISGPQFLKLSTSNKVTSSDPPGSSLDSDWITSKAFLVLQFEDSMLWDFSTSIIV

SEQ ID NO: 65 - DNA, 339 bp, Homo sapiens
  CDS (1)...(339)
atgtgggatgaatcaagtacaaccacatgtgttccaaaggtcaatgagaggctcttcgtgcttttagcattaattttgcctccattgacatcagagattctggataacaaccgcctcagacaaatatttgtagtgtttggccctcacaatcttctgcaagcagttggccagaagaaacacataaaacacagaacacagacgtatctggtcttttcagaaacagcaaatagagagccactgaaaactggctcccttggggctctgcaagaaacagctagcacctctggcgatggaggccagccacacctcactaccttgaaaagtagggtaactcagtag

SEQ ID NO: 66 - protein, 112 aa, Homo sapiens [sequence omitted]

SEQ ID NO: 67 - DNA, 264 bp, Homo sapiens
  CDS (1)...(264)
atggctgtcttagtacttcgcctgacagttgtcctgggactgcttgtcttattcctgacctgctatgcagacgacaaaccagacaagccagacgacaagccagacgactcgggcaaagacccaaagccagacttccccaaattcctaagcctcctgggcacagagatcattgagaatgcagtcgagttcatcctccgctccatgtccaggagcacaggatttatggaatttgatgataatgaaggaaaacattcatcaaagtga

SEQ ID NO: 68 - protein, 87 aa, Homo sapiens
MAVLVLRLTVVLGLLVLFLTCYADDKPDKPDDKPDDSGKDPKPDFPKFLSLLGTEIIENAVEFILRSMSRSTGFMEFDDNEGKHSSK

SEQ ID NO: 69 - DNA, 357 bp, Homo sapiens
  CDS (1)...(357)
atgggctcaaagaaggtagaagggttgggtccggacgaactgctgctgttactgttgctgctgctgctgctgctgctgctgctgctgctgctgctgtccagcagggcagaagactgcagtggccgggtgtccagtgttgttgggcccagtgggagtgaactgagctcaccactgtccttgctatcagtcccagggccgccactcactacaatgatagcccccaaacccagtcatacaagaggaagtaacctgaaattagtcaccacaggagacagggacacaagacctacagaagaagactcgtggtcaacatgtctgctgtggccatacttcaagacgggctaccagggcaattga

SEQ ID NO: 70 - protein, 118 aa, Homo sapiens
MGSKKVEGLGPDELLLLLLLLLLLLLLLLLLLSSRAEDCSGRVSSVVGPSGSELSSPLSLLSVPGPPLTTMIAPKPSHTRGSNLKLVTTGDRDTRPTEEDSWSTCLLWPYFKTGYQGN

SEQ ID NO: 71 - DNA, 474 bp, Homo sapiens
  CDS (1)...(474)
atgaaggcagcctgctcttccctctgcttgtcactgttggctttagaagccacctggggattaggagcagcaggtgacaagcactttgaagatgccctcccagtgtcggggctggctcctgatgtgcagtgtcggcacctcggcacttggggcgactgttgtggctgtgctgatttgctcatgatgcgccacgacctggactccagttacttgcacgtgggatcccctgctgtcgtccgcaagtcaccgagggggtgtggaggagccttgcctgacagccggagggagctggagtctgaaatgtcagctgctctttttacagaacgttatgtcacaggccttcaaataagagcgcccaatttcggctcaagacgcgcactgagcagagatatggagctggccctgaccacgctgtggagcccgtgctggtccctcaagcctccagccacctgcacgcggggccagccaggccag

SEQ ID NO: 72 - protein, 158 aa, Homo sapiens [sequence omitted]

SEQ ID NO: 73 - DNA, 411 bp, Homo sapiens
  CDS (1)...(411)
atgcgcccgctgctgctgaccaagagggcattacttcttccatcctcacatctggctcaagcggaaatgaagctggccttccccatgttcaaagtccaggcatgccagcccgattcacactcggctcagagacctctgacccaattacccctggttcctggtgagcctcgctgcaagacggaagcctgtcaccccggccccatccctcaaggtgaaacgtgctgggccctgctcctccactgctctgatcatcaagccttcatccagctctgtgctggggccacggacagcgtgtctggaggcaccattgacgtgggacagcatcatgggaccgcacatgcaagacatgccccaaaatggtctcagaaccacactgcttctggtgcagcccacagcggtcttttcctataa

SEQ ID NO: 74 - protein, 136 aa, Homo sapiens [sequence omitted]

SEQ ID NO: 75 - DNA, 678 bp, Homo sapiens
  CDS (1)...(678)
atgtacttggtggcgggggacagggggttggccggctgcgggcacctcctggtctcgctgctggggctgctgctgctgctggcgcgctccggcacccgggcgctggtctgcctgccctgtgacgagtccaagtgcgaggagcccaggaactgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaaggtacggccgcccgctgcgggccccctcccacctggcctgcgccgccccctcggcgctggttgtgccgaacaaagtttgggcgagactttctggaggaaagagggctctgcgggaagaggggcggccgccgcccccaggagagtgcccccgcggccctgcgttccctctccttgttccccccgacgcttaggcagtcgcgggcgaggttgggtatggctgcctgcctccaggaaaatcacctagaagccagagaaacaagtgtggatcctgaacccctgagaaagaaatctggatggaagacatctttggaggatcgaaggcagagtttagaaaaattaatgaagtga

SEQ ID NO: 76 - protein, 225 aa, Homo sapiens
MYLVAGDRGLAGCGHLLVSLLGLLLLLARSGTRALVCLPCDESKCEEPRNCPGSIVQGVCGCCYTCASQRNESCGGTFGIYGTCDRGLRCVIRPPLNGDSLTEYEAGVCEGTAARCGPPPTWPAPPPRRWLCRTKFGRDFLEERGLCGKRGGRRPQESAPAALRSLSLFPPTLRQSRARLGMAACLQENHLEARETSVDPEPLRKKSGWKTSLEDRRQSLEKLMK

SEQ ID NO: 77 - DNA, 558 bp, Homo sapiens
  CDS (1)...(558)
atggcccgggccagggccggggcgctgctggcgctttgggtgctcggggccgccgcgcatccgcagtgcctggacttcaggccgcccttccggccgacgcagccgctgcgcctctgcgcgcagtactcggacttcggctgctgcgatgaggggcgcgacgccgagctgacccgccgcttctgggccctggcgagccgcgtggacgccgccgagtgggccgcgtgcgccggctacgcgagggacctgctgtgccagtccgtggagtggacagacatgcaaagagataatgaagtcctagccaagctgactggctggagcgcccctggcgacggagcagtgactgctgtagagaactcaccctgtaagctacaagattcaatggattctggattgggctttggtgaacggagggctctcgttgccttccagatgtctgttctgcccctcactgcgtctctggaaccaagatggtgcctggtacaatctctgctcagtaaattcttggtgaatgaaatgttgctgactaatctggaaagaacaccagtccaggcatcatga

SEQ ID NO: 78 - protein, 185 aa, Homo sapiens
MARARAGALLALWVLGAAAHPQCLDFRPPFRPTQPLRLCAQYSDFGCCDEGRDAELTRRFWALASRVDAAEWAACAGYARDLLCQSVEWTDMQRDNEVLAKLTGWSAPGDGAVTAVENSPCKLQDSMDSGLGFGERRALVAFQMSVLPLTASLEPRWCLVQSLLSKFLVNEMLLTNLERTPVQAS

SEQ ID NO: 79 - DNA, 645 bp, Homo sapiens
  CDS (1)...(645)
atgcccgcggcccggccgcccgccgcgggactccgcgggatctcgctgttcctcgctctgctcctggggagcccggcggcagcgctggagcgaggggtggtcagtgaaggcttcctggagcacgtagcatttgaactggccctgaaggggataggacagacacagaccctggagtccaagagatatgggttcaaacctaatgctgtgatcttgaacaagtcacttaactctgagatgatgggagtgggtggtagtgatgaggatgaagaggggaattatgagttgctgttgttactgatggaccgagctgattctcagacatttaaaagtgatccaggcattgaaaatcaggttggagtggaaaatgaagagaagcctcaaggtggggtcccaggagctctccccttttcccatgagagattcatctggaatgatgacagtggatttaagagcaataagggaggggaacggctgagccagggacctgtggacactcaggattcaactctgggcttggccagagataagtccttagagtttggggcatttgaacaactgacaagaagccagcatggccagaatatcctgaacagagaaggaagtgggcaaatgaagttaagagaaagtattaaagaaaagcaatga

SEQ ID NO: 80 - protein, 214 aa, Homo sapiens
MPAARPPAAGLRGISLFLALLLGSPAAALERGVVSEGFLEHVAFELALKGIGQTQTLESKRYGFKPNAVILNKSLNSEMMGVGGSDEDEEGNYELLLLLMDRADSQTFKSDPGIENQVGVENEEKPQGGVPGALPFSHERFIWNDDSGFKSNKGGERLSQGPVDTQDSTLGLARDKSLEFGAFEQLTRSQHGQNILNREGSGQMKLRESIKEKQ

SEQ ID NO: 81 - DNA, 303 bp, Homo sapiens
  CDS (1)...(303)
atggcagccttgctgctcttgaccctcagcctgattcaggtctcaggggtgctgctgacctccagtgtggacagtccctctaccctgccgctgtctgcacagagaaccgtccaccgtggcctctttacattccaagctggattttctcctgatcgctccagttctcgaggcaaaaagcaaagagtctcgggctgcaatgacatggtttgcttcgggttctccggcgccgcctgcctcctctgtcagatgccggtgttcgggggcggcttcgttggcttccttccttctctgttccagacctaa

SEQ ID NO: 82 - protein, 100 aa, Homo sapiens [sequence omitted]

SEQ ID NO: 83 - DNA, 1533 bp, Homo sapiens
  CDS (1)...(1533)
atggcttgggcaagtaggctgggcctgctgctggcactgctgctgcccgtggtcggtgcctccacgccaggcaccgtggtccgactcaacaaggcagcattgagctacgtgtctgaaattgggaaagcccctctccagcgggccctgcaggtcactgtccctcatttcctggactggagtggagaggcgcttcagcccaccaggatccggattctgaatgtccatgtgccccgcctccacctgaaattcattgctggtttcggagtgcgcctgctggcagcagctaattttactttcaaggtctttcgcgccccagagcccctggagctgacgctgcctgtggaactgctggctgacacccgcgtgacccagagctccatcaggacccctgtggtcagcatctctgcctgctctttattctcgggccacgccaacgagtttgatggcagtaacagcacctcccacgcgctgctggtcctggtgcagaagcacattaaagctgtcttgagtaacaagctgtgcctgagcatctccaacctggtgcagggtgtcaatgtccacctgggcaccttaattggcctcaaccccgtgggtcctgagtcccagatccgctattccatggtcagtgtgcccactgtcaccagtgactacatttccctggaagtcaatgctgttctcttcctgctgggcaagcccatcatcctgcccacggatgccaccccttttgtgttgccaaggcatgtgggtaccgagggctccatggccaccgtgggcctctcccagcagctgtttgactctgcgctcctgctgctgcagaaggccggtgccctcaacctggacatcacagggcagctggtggcccgccagtttcccgagcccatgcctgtggtgctcaaggtgcggctgggtgccacacctgtggccatgctccacacaaacaacgccaccctgcggctgcagcccttcgtggaggtcctggccacagcctccaactcggctttccagtccctcttctccctggatgtggtagtgaacttgagactccagctctctgtgtccaaggtgaagcttcaggggaccacgtctgtgctgggggatgtccagctcacggtggcctcctccaacgtgggcttcattgatccctcaccccaaaagtccattggtcagttggacaaagaatgtcagctgtcccttcagccaggtgatgtgattgggtcatcggccaccatacatccacttgtcagccggcatgccatcaacatgccccccttctacccagccgtcagtctgtctgtctgtcggtcatctgcgtcaggcagtctgctggccagtccacctgttggtcacacaacagatcaggtgcgcacactgatgggcaccgtttttgagaagcccctgctggaccatctcaatgctctcttggccatgggaattgccctccctggtgtggtcaacctccactatgtcgcccctgagatctttgtctatgagggctacgtggtgatatccagtggactcttctaccagagctga

SEQ ID NO: 84 - protein, 510 aa, Homo sapiens
MAWASRLGLLLALLLPVVGASTPGTVVRLNKAALSYVSEIGKAPLQRALQVTVPHFLDWSGEALQPTRIRILNVHVPRLHLKFIAGFGVRLLAAANFTFKVFRAPEPLELTLPVELLADTRVTQSSIRTPVVSISACSLFSGHANEFDGSNSTSHALLVLVQKHIKAVLSNKLCLSISNLVQGVNVHLGTLIGLNPVGPESQIRYSMVSVPTVTSDYISLEVNAVLFLLGKPIILPTDATPFVLPRHVGTEGSMATVGLSQQLFDSALLLLQKAGALNLDITGQLVARQFPEPMPVVLKVRLGATPVAMLHTNNATLRLQPFVEVLATASNSAFQSLFSLDVVVNLRLQLSVSKVKLQGTTSVLGDVQLTVASSNVGFIDPSPQKSIGQLDKECQLSLQPGDVIGSSATIHPLVSRHAINMPPFYPAVSLSVCRSSASGSLLASPPVGHTTDQVRTLMGTVFEKPLLDHLNALLAMGIALPGVVNLHYVAPEIFVYEGYVVISSGLFYQS

SEQ ID NO: 85 - DNA, 453 bp, Homo sapiens
  CDS (1)...(453)
atggctgtcctggtggtctctcttgggtccctcgctctaggggaagaagtcctgttagtggccccatggagaggcccacacagcaaggaactgaagcttcctgcccacagcaacgagagaaagcttagaggtagccctcaggtcccagccaagtcttcagagccggccactctggccaacagcttgagtacaactgcacgcaagccgcaagccggaaccactgggctaggatgctcccagattctgagctctgaggatttgactcaggcaaagattattgctgctggcagaaggtcgaggcaaaaattctctaccttggagggaagggtggatacagatatcaaacagatgtctagtcttgctaggaatggggccgaaaactcccaccctacgccaaccatggacacaaggagaagtttggcagccacaggtagaaggagcaagaatgcttag

SEQ ID NO: 86 - protein, 150 aa, Homo sapiens
MAVLVVSLGSLALGEEVLLVAPWRGPHSKELKLPAHSNERKLRGSPQVPAKSSEPATLANSLSTTARKPQAGTTGLGCSQILSSEDLTQAKIIAAGRRSRQKFSTLEGRVDTDIKQMSSLARNGAENSHPTPTMDTRRSLAATGRRSKNA

SEQ ID NO: 87 - DNA, 438 bp, Homo sapiens
  CDS (1)...(438)
atgggccgccgccgcctgctcgtctggctgtgcgccgtcgcggcgctgctctcgggggcgcaggccaggggcaccccgctcctggcgcggcctgcgccgcccggtgcctcccgctacagtctctacacgacgggatggcgcccgcggctgcgcccggggccgcacaaggccctctgtgcctatgtggtgcacaggaatgtgacctgcatcctacaggagggagcggagagctacgtaaaggctgaataccggcagtgtagatgggggcccaagtgccccgggacagtcacgccacagaccgcgtatgcgttcagactccaggagcgtctctcgagtgggtctgcatctcatgcagaatatcgcgggtctcacgacagcattaatcgaggactcggttcactacggtgtgctcggatgtatgctcagctagttatttga

SEQ ID NO: 88 - protein, 145 aa, Homo sapiens
MGRRRLLVWLCAVAALLSGAQARGTPLLARPAPPGASRYSLYTTGWRPRLRPGPHKALCAYVVHRNVTCILQEGAESYVKAEYRQCRWGPKCPGTVTPQTAYAFRLQERLSSGSASHAEYRGSHDSINRGLGSLRCARMYAQLVI

SEQ ID NO: 89 - DNA, 372 bp, Homo sapiens
  CDS (1)...(372)
atgctgctgctgctcctgttgctgctgctgctacagctccaggcccttgctctggtgccactggagcaaaatctctccccaagaccccgggtgaagagtgctgctccaacacaacaaccagtcacctgcttgctgaggattggttgtcatgctcctgcttggcccacaagcatctcccacaagaaattctgcaggaaatccagggtcctgtctgaacccaaagatgtttctatctatcgaatgttccctggtcattggttgaaggccatcaagtcggcggtgaaagtcttacccagtacttacacagtacttcagcttagctgcgaaaatatcaatgagctgccgaactgtgtggaccccaagccaggctga

SEQ ID NO: 90 - protein, 123 aa, Homo sapiens
MLLLLLLLLLLQLQALALVPLEQNLSPRPRVKSAAPTQQPVTCLLRIGCHAPAWPTSISHKKFCRKSRVLSEPKDVSIYRMFPGHWLKAIKSAVKVLPSTYTVLQLSCENINELPNCVDPKPG

SEQ ID NO: 91 - DNA, 618 bp, Homo sapiens
  CDS (1)...(618)
atggagttgctgttactggcggtgttgagtcgggggactggggcagttgcactgctgtctgactgcattttcaaagggcagcagtgctgtgctgggggtctgctccagtccctagtcacctcgtactccctaaatgctgaaggcaaacaacagctaaggctgcaaaacagcaaagatgatgacctgcccctccctctgggagctccaacccacggggggatggggctgctgaaaacaccagcaaagggtgactggagaccctggtcctgcccaaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttacaacggatgtgaaggacctcttcaaggagaactacaaaccactgctcaaggaaataaaagaggacacaaacaaatggaagaacattccatgctcatgggtaggaagaatcaatatcgtgaaaatggccatactgcccaagacctccaggactgtgatgagaggggctactgccaagatctctga

SEQ ID NO: 92 - protein, 205 aa, Homo sapiens
MELLLLAVLSRGTGAVALLSDCIFKGQQCCAGGLLQSLVTSYSLNAEGKQQLRLQNSKDDDLPLPLGAPTHGGMGLLKTPAKGDWRPWSCPNSAVNPSGPGLFLVGKLLIIATISEPVIGLFRDSTSSWFSLGRVYVSRNVSISYNGCEGPLQGELQTTAQGNKRGHKQMEEHSMLMGRKNQYRENGHTAQDLQDCDERGYCQDL

SEQ ID NO: 93 - DNA, 342 bp, Homo sapiens
  CDS (1)...(342)
atggcggcggccccacgcgcgggccggcggcgcgggcagccgctcctggcgctgctgcttctgctgctggcgccactgccgccgggggccccgccgggcgccgacgcctacttccccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatggacggagcccagagcccccactggggcgttgccagaggccacatctaacagcaagcctttctgtgccggctgctgcccttaa

SEQ ID NO: 94 - protein, 113 aa, Homo sapiens
MAAAPRAGRRRGQPLLALLLLLLAPLPPGAPPGADAYFPEERWSPESPLQAPRVLIALLARNAAHALPTTLGALERLRHPRERTALWTEPRAPTGALPEATSNSKPFCAGCCP

SEQ ID NO: 95 - DNA, 343 bp, Homo sapiens
  CDS (1)...(343)
atgacagcaagccgccagatgtttagactttctgttctccttgctggctctgtattgccagccctggctactgctgttagaaacctttctgagactagaccagttaaacttgtggttccgtgggttgatatccagaaattagaaagaacgtccaatgtctttctgacggataccatccgaatcaccacgcagaataaggagcgtgacttctccatgttcctgaacctggatgaggtgtttaaggtcatggagcagctggccgacgtgacgctgcgaaggctgctggataatgagtctttgacctcgaccccgatctgcaggagccgagccagatcaccaagag

SEQ ID NO: 96 - protein, 114 aa, Homo sapiens
MTASRQMFRLSVLLAGSVLPALATAVRNLSETRPVKLVVPWVDIQKLERTSNVFLTDTIRITTQNKERDFSMFLNLDEVFKVMEQLADVTLRRLLDNESLTSTPICRSRARSPR

SEQ ID NO: 97 - DNA, 420 bp, Homo sapiens
  CDS (1)...(420)
atgctgctgctgctgctgttgtttatgagacagggtctggctctgtcacccagcctggagtgcagtgacgtcatcattgcccactgcagcctcagcctcgtgggctcgagtgatcctcctgaaacaacatatattggcaccctccttgtgtctgtgaatccataccaggagctcggaatctacactgtgctgtgcaagtccaagaacattatcctgagggaatgcttcctgctggccgagttagaaaaccggaggaggcccccaacaggcttgtccaataagggtgtggcctatctccctactggacctcttctggagggagcctcaacgcccaaaagacctaataacaacaataaaattgtgggcacattgccaatgatgggaggtggctcccccaaggctcaagagtggagctggtga

SEQ ID NO: 98 - protein, 139 aa, Homo sapiens [sequence omitted]

SEQ ID NO: 99 - DNA, 2172 bp, Homo sapiens
  CDS (1)...(2172)
atggctctcagcctctggcccctgctgctgctgctgctgctgctgctgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcggcccccatgcacccgtgatgggccgtctgactgtgtcctggctgctgactggttgccttctctgctgctgttgttagagggcacacgctggcaagctctggtgcaggtgcagcccagtgtggaccccaccaatgccacaggcctcgatgggagggaggcagctcctcactttttgcagggtctgttgggtttgcttaccccaacaggggagctaggctccaaggaggctctttggggcggtctgctacgcacagtgggggcccccctctatgctgcctttcaggaggggctgctccgtgtcactcactccctgcaggatgaggtcttctccattttggggcagccagagcctgataccaatgggcagtgccagggaggtaaccttcaacagctgctcttatggggcgtccggcacaacctttcctgggatgtccaggcgctgggctttctgtctggatcaccacccccaccccctgccctccttcactgcctgagcacgggcgtgcctctgcccagagcttctcagccgtcagcccacatcagcccacgccaacggcgagccatcactgtggaggccctctgtgagaaccacttaggcccagcaccaccctacagcatttccaacttctccatccacttgctctgccagcacaccaagcctgccactccacagccccatcccagcaccactgccatctgccagacagctgtgtggtatgcagtgtcctgggcaccaggtgcccaaggctggctacaggcctgccacgaccagtttcctgatgagtttttggatgcgatctgcagtaacctctccttttcagccctgtctggctccaaccgccgcctggtgaagcggctctgtgctggcctgctcccaccccctaccagctgccctgaaggcctgccccctgttcccctcaccccagacatcttttggggctgcttcttggagaatgagactctgtgggctgagcgactgtgtggggaggcaagtctacaggctgtgccccccagcaaccaggcttgggtccagcatgtgtgccagggccccaccccagatgtcactgcctccccaccatgccacattggaccctgtggggaacgctgcccggatgggggcagcttcctggtgatggtctgtgccaatgacaccatgtatgaggtcctggtgcccttctggccttggctagcaggccaatgcaggataagtcgtgggggcaatgacacttgcttcctagaagggctgctgggcccccttctgccctctctgccaccactgggaccatccccactctgtctgacccctggccccttcctccttggcatgctatcccagttgccacgctgtcagtcctctgtcccagctcttgctcaccccacacgcctacactatctcctccgcctgctgaccttcctcttgggtccaggggctgggggcgctgaggcccaggggatgctgggtcgggccctactgctctccagtctcccagacaactgctccttctgggatgcctttcgcccagagggccggcgcagtgtgctacggacgattggggaatacctggaacaagatgaggagcagccaaccccatcaggctttgaacccactgtcaaccccagctctggtataagcaagatggagctgctggcctgctttagtgtgagtgctctgccagagggaaagctcctagaacagtga

SEQ ID NO: 100 - protein, 723 aa, Homo sapiens
MALSLWPLLLLLLLLLLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTRPPCTRDGPSDCVLAADWLPSLLLLLEGTRWQALVQVQPSVDPTNATGLDGREAAPHFLQGLLGLLTPTGELGSKEALWGGLLRTVGAPLYAAFQEGLLRVTHSLQDEVFSILGQPEPDTNGQCQGGNLQQLLLWGVRHNLSWDVQALGFLSGSPPPPPALLHCLSTGVPLPRASQPSAHISPRQRRAITVEALCENHLGPAPPYSISNFSIHLLCQHTKPATPQPHPSTTAICQTAVWYAVSWAPGAQGWLQACHDQFPDEFLDAICSNLSFSALSGSNRRLVKRLCAGLLPPPTSCPEGLPPVPLTPDIFWGCFLENETLWAERLCGEASLQAVPPSNQAWVQHVCQGPTPDVTASPPCHIGPCGERCPDGGSFLVMVCANDTMYEVLVPFWPWLAGQCRISRGGNDTCFLEGLLGPLLPSLPPLGPSPLCLTPGPFLLGMLSQLPRCQSSVPALAHPTRLHYLLRLLTFLLGPGAGGAEAQGMLGRALLLSSLPDNCSFWDAFRPEGRRSVLRTIGEYLEQDEEQPTPSGFEPTVNPSSGISKMELLACFSVSALPEGKLLEQ

SEQ ID NO: 101 - DNA, 456 bp, Homo sapiens
  CDS (1)...(456)
atgctgagcagccagtatgggctgatcgtgttcgtggcggggctgctgctgctgctggcctgggccgttcgaccgcgggcatgctgtggtacgtgggccgcactccggaaccgccgcctcttccgcctcaaggacacgcacgccggcgccggctggctgcaccggctggagcctcctctccgcctccagacgcttccatcattacagccacagttacagaaacctctcctgtccttccctggcttaaagccatacagtggccctactgaccccatgagggagttcagttctgttgctgatgtactatggctgcaagctgccaaatgctgcttccctctgcttgttaaagagccaagcaacccatctgatttaccgagtagagctcgttcaggaccttcatcaaatcatcttggagctgctggccgacttctttactctgcaaggaaagaggaatga

SEQ ID NO: 102 - protein, 151 aa, Homo sapiens [sequence omitted]

SEQ ID NO: 103 - DNA, 414 bp, Homo sapiens
  CDS (1)...(414)
atggggcgagtccggaccttggcgggcgagtgctcggcgcaggcgcaagcgcagagtctcctcgcggtcgtccttttggcccctcccctctgggggacccccagtgccaggctgtcagtgcgcagcccccagcctgcgggacccctggggactctgggcgcctgttctgcaaatgaccggttcttacgagttcaagctgaaccagccacccgaggatggcatctcctccgtgaagttaagcccccacacccttcccagtcctgggttgtctccttcctgggagacgttccgtgcgtctttacgatgtggccgggcaacttcatggcggttaagtaccaagcacaccggggcccgtcctgggaatgggcctttttaatttcaatttacccccttggccggagagtcaaatgttga

SEQ ID NO: 104 - protein, 137 aa, Homo sapiens [sequence omitted]

SEQ ID NO: 105 - DNA, 1260 bp, Homo sapiens
  CDS (1)...(1260)
atggggcccatgctgctgcctctggctctgctggccctgctgctggggcctgcgctggcccggagtgcccgggacccggaggtgttctgtggaggcgtcatattagcaataaaatgcatgaaaccagcattctttgccaccttctcgctaatcattgctattttctcggagagagaggctcttggcaaaggtcacagccctggacccggttttccttcctggaatatttgggtggtgacatcgcagctgagccccttccatggaattctgtggtgttgggctgttcttcaagagaagattaggacacagacacacacagagggacggccacgtgaggacatagggagaagacagctgtctgcaagtcaaggaggggcctcagaaggaaccaaccctcctgacaccttgatcttggacttccagctgcagaacgggtgttttggcaaatacaccttcatctgctcttcacctggtaaatgcctgatcatctttcaggtcctacttgtcatgctcttagggaagcctcccgtgttctttgacaagaaggtcccgtcggtggatcaaggccctccctactccagtatgacttggtctgaatcaatcccatctgcaaagaccctattcccaaataaggccacattcacagcgtgcagggcgctgatggacgagatagagcacgacatcaccaaggctcggcagaagaagaccaaggtgggatccttccgaatcaatcccgatgggactcaggagaggagaaagcacctaaattttgtgtctcgtcaagtcgaaagacatttcggcactgttcttcatcagaataaaaatagcgcgtctgtggttcttggcacactcaaggatggatccttcaagagccgtgtctggcaagtccaccggagggaccccgtgcaggcccactggctgctctgctgcaggtctgacgcctgcaccccggaatctcaaggtcctttgtggtcacctgaatgcaggacatgtgcctccataaaatccagtacagtcctggtccctgacaccagccgggagctgattcccactgtcaagcagggccagggaagatcattccgggtctacatgtggtgtggactaggggaggaattcttcccccataggagctcacactctgacccagagacctcagcagccgccagtgtgaacgccacgtctcagagagtgaagggagggagcctcaggaaatacactgagacaatagtcacagttcttgtatctgcgtattactgctga

SEQ ID NO: 106 - protein, 419 aa, Homo sapiens [sequence omitted]

SEQ ID NO: 107 - DNA, 669 bp, Homo sapiens
  CDS (1)...(669)
atggcgcctcctctgcgacccctcgcccggctgcgaccgccggggatgctgctccgcgcgctcctgctcctgctgctgctcagtcctttgccagggctgcgagagggaataggtgaactcataaccccaatcggcaccagcttgccggatctggatccagccaggaggagatgggagggtggaattggcagggttggaagtgaagtggccgatttgtgccccggaaaggaggggggaaaagtccccgaagctgaaaaggaaggagtgtggtgctttagcgaactgtcttttgtaaaagaaccacaggatgtaactgtcacaagaaaggacccagtcgttttagattgccaggctcacggagaagttcctattaaggtcacatggttgaaaaatggagcaaaaatgtctgaaaataaacggatcgaggttctttctaacggctctttatacatcagtgaggtggaaggcaggcgaggagagcagtccgatgaaggattttatcagtgcttggcaatgaacaaatatggagccattcttagtcaaaaagctcatcttgccttatcaatgttagcggcatccctggcctctaccctcccaataccgatagactctcttccagttgtgacaaccaagaaagttctactgtggggcaaaataactcctgattga

SEQ ID NO: 108 - protein, 222 aa, Homo sapiens
MAPPLRPLARLRPPGMLLRALLLLLLLSPLPGLREGIGELITPIGTSLPDLDPARRRWEGGIGRVGSEVADLCPGKEGGKVPEAEKEGVWCFSELSFVKEPQDVTVTRKDPVVLDCQAHGEVPIKVTWLKNGAKMSENKRIEVLSNGSLYISEVEGRRGEQSDEGFYQCLAMNKYGAILSQKAHLALSMLAASLASTLPIPIDSLPVVTTKKVLLWGKITPD

SEQ ID NO: 109 - DNA, 864 bp, Homo sapiens
  CDS (1)...(864)
atgcggcaaaccctaccgctgctgctgctgacggtgctgcgccccagctgggcagaccctccccaggagaaggtcccgctcttccgggtcactcagcagggcccctgggggagcagtggcagcaacgccaccgactcgccctgcgaggggctgcccgccgcggatgcgacggccttgaccctggcgaaccgcaacctggagcgcctgcccggctgcctaccgcgcacactgcgcagcctcgacgccagccacaacctgctgcgcgccctgagcacttccgagctcggccacctggagcagctgcaggtgctgaccctgcgccacaaccgcatcgccgcgctgcgctggggcccgggtgggccggcggggctgcacaccctggacctcagctacaaccagctggccgctctgccgccgtgcaccgggcccgcgctgagcagcctccgcgccctggcgctcgccgggaatccgctgcgggcgctgcagccccgggccttcgcctgcttccccgcgctgcagctcctcaacctctcctgcaccgcgctgggtcgcggagcccaggggggcatcgccgaggcggcgttcgctggagaggatggcgcgcccctggtcacgctcgaagtcctggatctcagcggcacgttccttgaacgggttgagtcagggtggatcagagacctgccgaagctcacatccctctacctgaggaagatgcctcggctgacgaccctggagggggacattttcaagatgacccccaacctgcagcagctggactgtcaggactccccagcacttgcttctgtcgccacacacatctttcaagatactccacatctacaggtccttctgttccagaagtaa

SEQ ID NO: 110 - protein, 287 aa, Homo sapiens
MRQTLPLLLLTVLRPSWADPPQEKVPLFRVTQQGPWGSSGSNATDSPCEGLPAADATALTLANRNLERLPGCLPRTLRSLDASHNLLRALSTSELGHLEQLQVLTLRHNRIAALRWGPGGPAGLHTLDLSYNQLAALPPCTGPALSSLRALALAGNPLRALQPRAFACFPALQLLNLSCTALGRGAQGGIAEAAFAGEDGAPLVTLEVLDLSGTFLERVESGWIRDLPKLTSLYLRKMPRLTTLEGDIFKMTPNLQQLDCQDSPALASVATHIFQDTPHLQVLLFQK

SEQ ID NO: 111 - DNA, 603 bp, Homo sapiens
  CDS (1)...(603)
atggaaaaggaattaatcttctcaccctggcgagttttcctgaaactacttatccttagcgtcagcgctgtaagaggtggagccgctcagtcccgcgggtggctgcagacagaaggggtagtggacagtgttgacttgaattgctgtccctcgttccaagcctttcctgtgaatgaacccgaaaacactcgacaggtcgtgaataatcgttttaatgagtgtgcaaagcgtgcgacgggacacactttcggtcccccgccagagctccggtgcccccgagtgaccgctttctgcgatcgcgtccgccgggaccccgtccctctttccccttcagtcttcagggagggggaggcgctccgcattagcggggcagttcagcaaccccgaccccacccgcgtggctccaggcccaggggtccgttcacttccccgtccggtttgggggacgccaattcgcctaagaaaaccctggcagaagagcgcggacccttcactacaaacctcacgtcagggttacagccacatttaggaacctcttcggaaaagctgagaaatcactgttttgcaaaaagccttctgtactgtgatggggctttgtggtga

SEQ ID NO: 112 - protein, 200 aa, Homo sapiens
MEKELIFSPWRVFLKLLILSVSAVRGGAAQSRGWLQTEGVVDSVDLNCCPSFQAFPVNEPENTRQVVNNRFNECAKRATGHTFGPPPELRCPRVTAFCDRVRRDPVPLSPSVFREGEALRISGAVQQPRPHPRGSRPRGPFTSPSGLGDANSPKKTLAEERGPFTTNLTSGLQPHLGTSSEKLRNHCFAKSLLYCDGALW

SEQ ID NO: 113 - DNA, 285 bp, Homo sapiens
  CDS (1)...(285)
atggcttcagtggcctgggccgtcctcaaggtgctgctgcttctccccactcagacttggagccccgtaggagcaggaaatccacttagctattcgtctaatcctttttcaaggtttttagcttctttgcgacgggttcgaacatcctcctttagctcggagaagtttgttattaccgatcatctgaaaccttcttctctcaactcgtcaaagtcattctccatccagctttgttccgttgctggcgaggcgttgtgttcctttggaggagaagaggcgctctga

SEQ ID NO: 114 - protein, 94 aa, Homo sapiens [sequence omitted]

SEQ ID NO: 115 - DNA, 312 bp, Homo sapiens
  CDS (1)...(312)
atggccctgctccccactgttttgtgtctatgggcacaggcacaggtgggtgtccagagacataatcacatcttctggaatgagaaggagcatggccatgggaagagcgggaggccagtgcctgctacgcttagaatgacgagagagaaacgagagaatgacagtctttccactacctcagatttgttcatgacactgcccagtgccggtgagatgcactcccctgccaggcgttggcccacagcagcaggaggcttcattaagcaggacatctacattttcgtgctgctggaacatcctgggagctcttaa

SEQ ID NO: 116 - protein, 103 aa, Homo sapiens
MALLPTVLCLWAQAQVGVQRHNHIFWNEKEHGHGKSGRPVPATLRMTREKRENDSLSTTSDLFMTLPSAGEMHSPARRWPTAAGGFIKQDIYIFVLLEHPGSS

SEQ ID NO: 117 - DNA, 423 bp, Homo sapiens
  CDS (1)...(423)
atgccgccactgctggtcctgctcttgctcctgccgccaccacttgcacctcccctcttcagccagtgtggtggcagcggctgctcccgacagcccaccattcccatcagtaatatggaggggcaaatatgtgtaaagccttcaggtgccaaagctgctccagaacccctggaagaattatcaaagatgcggtccctctcttcaattccatggtatattttgtccttcagttctgcagagcctgcaatcaaacatgctaaagcagagaaatacaataagagacctatacttgacattagcagaggaagtccagctgtgtacactaattatgataaacatccattcacaatgtctgggaggagactagccacagacctggaaagaggtgaagaaaaacgacaccatgaaaaaggagcaaagtga

SEQ ID NO: 118 - protein, 140 aa, Homo sapiens
MPPLLVLLLLLPPPLAPPLFSQCGGSGCSRQPTIPISNMEGQICVKPSGAKAAPEPLEELSKMRSLSSIPWYILSFSSAEPAIKHAKAEKYNKRPILDISRGSPAVYTNYDKHPFTMSGRRLATDLERGEEKRHHEKGAK

SEQ ID NO: 119 - DNA, 336 bp, Homo sapiens
  CDS (1)...(336)
atgggatgcagactgctgaccctgctgtgtttcctacaacctgcttccagctcctcgtggctctttggctcccaatccagagctttcgcgaacaccagagcccctgtgcctctccctgcagctggctgggagttccagggcattaacacagacagtctttgcccatcagccagtgactgtatggagcttggatgtgaatacacagctcctgcatccctccgaggcatctccacaccgtctcccagagaatgtctcgtaaaagctgctcctcttggggaggctctgggctttggagagagcacctggaattccccactagaaaagcccaaaaactga

SEQ ID NO: 120 - protein, 111 aa, Homo sapiens
MGCRLLTLLCFLQPASSSSWLFGSQSRAFANTRAPVPLPAAGWEFQGINTDSLCPSASDCMELGCEYTAPASLRGISTPSPRECLVKAAPLGEALGFGESTWNSPLEKPKN

SEQ ID NO: 121 - DNA, 336 bp, Homo sapiens
  CDS (1)...(336)
atgaagctccttcttctgcttttgactgttactctgctcctggcccaggtcaccccaggtctgccagccatgaaacttctttacctgtttcttgccatccttctggccatagaagaaccagtgatatcagtagagtgttggatggatggacactgccggttgttgtgcaaagatggtgaagacagcatcatacgctgccgaaatcgtaaacggtgctgtgttcctagtcgttatttaacaatccaaccagtaacaattcatggaatccttggctggaccactcctcagatgtccacaacagctccaaaaatgaagacaaatataactaatagatag

SEQ ID NO: 122 - protein, 111 aa, Homo sapiens
MKLLLLLLTVTLLLAQVTPGLPAMKLLYLFLAILLAIEEPVISVECWMDGHCRLLCKDGEDSIIRCRNRKRCCVPSRYLTIQPVTIHGILGWTTPQMSTTAPKMKTNITNR

SEQ ID NO: 123 - DNA, 297 bp, Homo sapiens
  CDS (1)...(297)
atgccagagagcttcctgttgggactgggatggctggagggcatcacagcactggtttcgaacactgaacggagaactgccatgcaacaagaacctgggcacatcagacccctgcaggcaccctcgggacccacagatcgcacactcgatgggcgctcgcaggacgtgaatggcatctcggtaacgccaagctccaccccagagccacaggcaggcggcaacagggacaagcagacgacacacctggggccagaggacgacgcagagagacccacatcagagaccctcgaggagtga

SEQ ID NO: 124 - protein, 98 aa, Homo sapiens [sequence omitted]

SEQ ID NO: 125 - DNA, 630 bp, Homo sapiens
  CDS (1)...(630)
atgagatccgggaggcacccctcgctgctgctgcttctagtgctgctgctgtggctgctgcagacactgctcactagattagggcccactctaacccagtgtgacttcatcttaactgtaattcagttaagaattacatctgcaaatagcctatttccaaataaggtcccgttcacaggtaaacccaacggggtccatgcgcagtcctatacgatcttagtactcctcatcgcgtcccgaggtaatgtttgcagctgcgtagagtctatctttataggccggccgatggttgcgggtgcccctcgtcgcgggtgcgcgcacagggcaaccagaattaaaaccactattattaggcgaaacaagacgctggaggtggtaggcctcaaactgtttctgctcgtgtcgacggcggactcagttccccggaatgttcgggctgtgtcggaggaagacgcggaggaatcatctgcaggcagtctcgtccacgtatttcaaaaatttgcgaatatacccgtcgtggggaaatacccgtgctattttggggaggctttgcccagactttctcgattggattacagaatctaccgttactgctcgggatgccagaggttgcgatgctgtggagagtga

SEQ ID NO: 126 - protein, 209 aa, Homo sapiens [sequence omitted]

SEQ ID NO: 127 - DNA, 348 bp, Homo sapiens
  CDS (1)...(348)
atggggccccttatctcccccggcactttcccctacatccggctgcaactagaagctttcgcactaaccctcgtggctgccccacgctgggccctggcctttgtaaacggttcctttattaaactctctccaaatacccacggcatgcgtgtgacagcggactccttcctgcccgtcacaccggcgatgtgcacaaaaagtatctcagaccctctcctcaccccacctgatcccgtcaaaaaggcctccatgaacgccaccctccatgctggggtctcggggcctgcaagatcccagctcagtggatttgaaggaactgatgggcctggagtctggcagtgtgaatga

SEQ ID NO: 128 - protein, 115 aa, Homo sapiens
MGPLISPGTFPYIRLQLEAFALTLVAAPRWALAFVNGSFIKLSPNTHGMRVTADSFLPVTPAMCTKSISDPLLTPPDPVKKASMNATLHAGVSGPARSQLSGFEGTDGPGVWQCE

SEQ ID NO: 129 - DNA, 660 bp, Homo sapiens
  CDS (1)...(660)
atgggctcattggcttctgaggagagatactgggatgtctcggccttgctgatggcattaccccttccagctgcctctctccagaatgatctcaaccagggtggcccagggagcactaattccaagaggcaggccaactggtccttggaggaggagaagagcagactgctggctgaggcagcacttgagttgcgggaggagaacacgaggcaggaacggattctggccctggccaagcgactagccatgctgcggggacaggaccccgagagagtgaccctccaggactatcgcctcccagacagtgatgacgacgaggatgaggagacagccatccaaagagtcctgcagcagctcactgaagaagcttccctggatgaggcaagtggctttaacatccctgcagagcaggcttctcgaccctggacgcaaccccgcggggcagagcctgaggcccaggatgtggaccccaggcctgaggctgaggaagaggagctcccctggtgctgcatctgcaatgaggatgccaccctacgctgcgctggctgcgatggggacctcttctgtgcccgctgcttccgagagggccatgatgcctttgagcttaaagagcaccagacatctgcctactctcctccacgtgcaggccaagagcactga

SEQ ID NO: 130 - protein, 219 aa, Homo sapiens [sequence omitted]

SEQ ID NO: 131 - DNA, 252 bp, Homo sapiens
  CDS (1)...(252)
atgcagtggcttgctctgcttctcccacatgcaggcctagcccaggcaatgctgctgggcaggtcagagacctccacacctgtcctcttcgcgtgccacatggacacgggcctgcgcagcgtggccaacatctggttccaatgtgtggttcccatgccactggctgactaccccaatgatgacatggcccacgttgtccccacggagtcgctgctgctctcagccaccgtcacgcggagagacaggtcctga

SEQ ID NO: 132 - protein, 83 aa, Homo sapiens [sequence omitted]

SEQ ID NO: 133 - DNA, 378 bp, Homo sapiens
  CDS (1)...(378)
atggcaaaaataggcgaggagagcttaaattgtactccgagcgacgcgctccagtacaagggaatgtttcttatgtatctccttccaggagtgtttgggcaggtcaggtgcccaattccaccccaggacagtaagagaaaggtgcggagcaagcacccggctcgcaagatcagccgccgggatacaagaacccaccgactgctgctcaaccgcgcaagtccctggcctataagcccacacgccgaaacaaacaggaaggcggccctggcacagatcgctcactacccaaaacccccgaccagctggaacgccgaggccgacgacaacagtcaaggcacaagaatacgagaccaggccgcgccacacaggctgttctag

SEQ ID NO: 134 - protein, 125 aa, Homo sapiens
MAKIGEESLNCTPSDALQYKGMFLMYLLPGVFGQVRCPIPPQDSKRKVRSKHPARKISRRDTRTHRLLLNRASPWPISPHAETNRKAALAQIAHYPKPPTSWNAEADDNSQGTRIRDQAAPHRLF

SEQ ID NO: 135 - DNA, 87 bp, Homo sapiens
  CDS (1)...(87)
atgagctggccacacaaactgctgctgctgctgcttctaggtggctgccttgctggtatacttactccctacttcatgaactcatga

SEQ ID NO: 136 - protein, 28 aa, Homo sapiens
MSWPHKLLLLLLLGGCLAGILTPYFMNS

SEQ ID NO: 137 - DNA, 558 bp, Homo sapiens
  CDS (1)...(558)
atggggcttgatgaacagctttttggggcactagaagcctcctggggtacctgtcatgcccttgaacgtttcttggagcgtgcctttttccaccctgccatgaagcccgaagttcttctattggcaaccaaatttccactgtccctgggcaaaagaaaagggccctcatgtgcgcttagaagatctggcgaggacgaaatttatcatgtaaccagaaacctacagaatttgcttttcataggaaagtcagccaaaaatatcaacagccacaatttatcagacgccttcaggaaaaatgtcaaagccaggcatttgtctgaagtgacctatcctgcttcagaagtctatcagccatttccattcctgcttctgaatggaatcaatcagaaacatttccagcccccacttctggtaaccgaccagaatagctgcggactaagggttgccttaccaccccctgctccgacgtctagcaggaatccaccagatgcactgagactcctgtctcaaaaacataaccaaaataaccccaacggcattacaataaatatacaataa

SEQ ID NO: 138 - protein, 185 aa, Homo sapiens [sequence omitted]

SEQ ID NO: 139 - DNA, 303 bp, Homo sapiens
  CDS (1)...(303)
atgaccagagcacctctcctgctactatgtgttgccctggtgctgcttgggcatgtgaatggagccacagtaagaaatgaggacaaatggaagccactcaacaaccccagaaacagagatctgtttttcagaaggcttcaggcatattttaagggcagaggtcttgatcttggaacatttccaaatcctttccccacgaatgaaaatcctagacctctctctttccagtcagaacttactgcttctgcatctgcagattatgaagagcagaaaaactcctttcacaattatctcaaaggctga

SEQ ID NO: 140 - protein, 100 aa, Homo sapiens
MTRAPLLLLCVALVLLGHVNGATVRNEDKWKPLNNPRNRDLFFRRLQAYFKGRGLDLGTFPNPFPTNENPRPLSFQSELTASASADYEEQKNSFHNYLKG

SEQ ID NO: 141 - DNA, 687 bp, Homo sapiens
  CDS (1)...(687)
atgcggccccttaagcccggcgcccctttgcccgcactcttcctgctggcgctggctttgtccccgcacggagcccacgggaggccccgggggcgcaggggagcgcgcgtcacggataaggagcccaagccgttgcttttcctccccgcggccggggccggccggactcccagcggctcccggagcgcaggagctgggcgaggcactcgctttgggaagcctgagattagtacagcagaaaacagagcatctctgcagattcccagctctcggaaagaggtcagggtcatgagacatccacaggcagagaagtcgtgtgaatacggggaacacggaaaagccccggaaaaggaggtccgagggggcggcccgggcacttggggcagcgctggagggaggagggcaggacacgcaggaaaggaaggtggggacagaagcgagaagctcctcacacgtttctgttcacacccagcaagagcagagcaaggtgaagctgccggcgaggctgggacagaagggcccctctgcggggacatttggtggcctccaccgggcttgggaagaggagagggcctagggtggcctggggatgcctcgcagctagcggctggccgtgggaccacagctcctgatcccttctcctcaggctttatggctaagaaagcaaacaagggcttcttagtatga

SEQ ID NO: 142 - protein, 228 aa, Homo sapiens
MRPLKPGAPLPALFLLALALSPHGAHGRPRGRRGARVTDKEPKPLLFLPAAGAGRTPSGSRSAGAGRGTRFGKPEISTAENRASLQIPSSRKEVRVMRHPQAEKSCEYGEHGKAPEKEVRGGGPGTWGSAGGRRAGHAGKEGGDRSEKLLTRFCSHPARAEQGEAAGEAGTEGPLCGDIWWPPPGLGRGEGLGWPGDASQLAAGRGTTAPDPFSSGFMAKKANKGFLV

SEQ ID NO: 143 - DNA, 393 bp, Homo sapiens
  CDS (1)...(393)
atggggtttctccatgttgaggctggtctcgtactcctgacctcaggcgtggtcccgctcgcacgagggagcggtcgcccagggtgccgggaagtcggggaccggccagccgccgaccggccgcacccctccccgccgagctcgcgcgcccgcctcgtcagcacctttcccgcagcgcagccccacagtggtcacgagagccgcggcccgaaaagacgcgaaggtggtgacgtgtcccgtgcccagggcgctgcgcaggaggcattggcaactgacgtcctgcgcgccgcctggtggaagcaaagcagccgagccccccggaagcggcggcgcgggcgagtggagaacgtgacttacgtcatctggcggaggcgtgggggcggtgccgcgtga

SEQ ID NO: 144 - protein, 130 aa, Homo sapiens [sequence omitted]

SEQ ID NO: 145 - DNA, 666 bp, Homo sapiens
  CDS (1)...(666)
atggataccagcacctgctctggtggaagtgggaggggagtaaagtggactctgcgggagtccttggttttagttttgtttagtgcactggttttctcaaatgctggttatgctagctgtgaagctgtcacacagacagactcacgacctctggttagccagggtgttgcaggattttcaggttcccagtgggatgtgggtgcagaggcagacttctcctcctctcacaccttgggaactcacgtagagtttgcagcggtaagctgcttctttcaaagggtctgtgaattctttcagttttcctggtatgttcctgtggtggttcttggagcaaaacttcacaatctagaagagaaaggcgaggaatggcactgccttctgaaagatgactggcttctacttccttctcttgtccagttcatgaactccctggagttttgcaatgcagtcatacaggtggctcaccccttgattcgaaatcagcttgtcaattacatttacaatggatttttggtaccagtcttggctcctgctctccataagtggcaacttggaactgtcaagatgttctccaaggctgagtctgtcatagagaatgcaaggtctgctgtgggcatggagaggagcagtggtagcacaagtgccatagatttgccatctacttaa

SEQ ID NO: 146 - protein, 221 aa, Homo sapiens
MDTSTCSGGSGRGVKWTLRESLVLVLFSALVFSNAGYASCEAVTQTDSRPLVSQGVAGFSGSQWDVGAEADFSSSHTLGTHVEFAAVSCFFQRVCEFFQFSWYVPVVVLGAKLHNLEEKGEEWHCLLKDDWLLLPSLVQFMNSLEFCNAVIQVAHPLIRNQLVNYIYNGFLVPVLAPALHKWQLGTVKMFSKAESVIENARSAVGMERSSGSTSAIDLPST

SEQ ID NO: 147 - DNA, 438 bp, Homo sapiens
  CDS (1)...(438)
atggctcgggcagggggcatggggctgctgcgattacagctgcttctggtactgcccacactagcttctgcctgtgtgccctgcatctacctggttcccacgtggacgtccctatctgagacaccttttggaccaactctggacagaccctctccaaaatcaaaggtgcgctgggctgctaacctgatccaagacgagatcaatctagaaggacctgctggtgctgcaacccacgcttgggtcacctttgccagaaccggggtcatttgctttgggggtcctcaggccagtgctcagaaggctgcttgttgtagatggaggacagctcctcaggctgggaaatctctcaatgggaactgtgctcagaacagaacagaacttcccggatacttagatatttgggtggtattgatctccgcatcagtgtcctcgggttga

SEQ ID NO: 148 - protein, 145 aa, Homo sapiens
MARAGGMGLLRLQLLLVLPTLASACVPCIYLVPTWTSLSETPFGPTLDRPSPKSKVRWAANLIQDEINLEGPAGAATHAWVTFARTGVICFGGPQASAQKAACCRWRTAPQAGKSLNGNCAQNRTELPGYLDIWVVLISASVSSG

SEQ ID NO: 149 - DNA, 411 bp, Homo sapiens
  CDS (1)...(411)
atgtgggtgctgctgctgctgctgttggaggcaggcctcggggctctgactctggagggttgtgaattccagcggcacggggctgttgtgtgccttgttcacggccatctcccttccacccagtgtctagcccagtgtctgtacacagcagatgcgaagctacgtgacgttgtccgtgaaccagccgggcccgcgttgccctactcaactatgtcgaggagccccggtcaccagcggtctgacccatttaacaattctggctctaccgatatccagttgctcgcccgggtccactcaccgaaaatctctatatgtaattctaagcctaaaaagacgggcacgcaataccacgacggcgacctgctcacgttcgtccccagcgatgcactgggggaggcacgtcggcggtga

SEQ ID NO: 150 - protein, 136 aa, Homo sapiens [sequence omitted]

SEQ ID NO: 151 - DNA, 852 bp, Homo sapiens
  CDS (1)...(852)
atggtttcggcggcagcccccagcctcctcatccttctgttgctgctcctggggtctgtgcctgctaccgacgcccgctctgtgcccctgaaggccacgttcctggaggatgtggcgggtagtggggaggccgagggctcgtcggcctcctccccgagcctcccgccaccctggaccccggccctcagccccacatcgatggggccccagcccataaccctggggggcccatcaccccccaccaacttcctggatgggatagtggacttcttccgccagtacgtgatgctgattgctgtggtgggctccctggcctttctgctgatgttcatcgtctgtgccgcggtcatcacccggcagaagcagaaggcctcggcctattacccatcgtccttccccaagaagaagtacgtggaccagagtgaccgggccgggggcccccgggccttcagtgaggtccccgacagagcccccgacagcaggcccgaggaagccctggattcctcccggcagctccaggccgacatcttggccgccacccagaacctcaagtcccccaccagggctgcactgggcggtggggacggagccaggatggtggagggcaggggcgcagaggaagaggagaagggcagccaggagggggaccaggaagtccagggacatggggtcccagtggagacaccagaggcgcaggaggagccgtgctcaggggtccttgagggggctgtggtggccggtgagggccaaggggagctggaagggtctctcttgttagcccaggaagcccagggaccagtgggtccccccgaaagcccctgtgcttgcagcagtgtccaccccagtgtctaa

SEQ ID NO: 152 - protein, 283 aa, Homo sapiens
MVSAAAPSLLILLLLLLGSVPATDARSVPLKATFLEDVAGSGEAEGSSASSPSLPPPWTPALSPTSMGPQPITLGGPSPPTNFLDGIVDFFRQYVMLIAVVGSLAFLLMFIVCAAVITRQKQKASAYYPSSFPKKKYVDQSDRAGGPRAFSEVPDRAPDSRPEEALDSSRQLQADILAATQNLKSPTRAALGGGDGARMVEGRGAEEEEKGSQEGDQEVQGHGVPVETPEAQEEPCSGVLEGAVVAGEGQGELEGSLLLAQEAQGPVGPPESPCACSSVHPSV

SEQ ID NO: 153 - DNA, 696 bp, Homo sapiens
  CDS (1)...(696)
atgggcgagggctccaaagggccctgcatgtgctgttcccctgcctggatgcccacccccaagggtcacctcctccaggaagccttccttcttctcaggctgagttggctggttactgctgtgcctgctcttgactggggattctaccggggcgaggccaggctgctcttatccatcgtcatgtcctcagtgggcacacagagacctgtgaccatcagtcagtgtgacaggcccctggcaaccaccaatcgacttgttgtctccgtggctttgcaatttctgacatttcatgaaagtggaatcacaagtgccctccgtgtccggcctcttccacagagcgttgagttttcaaggttcgtccctgttgtagcaggaatccgtgcttcacttaggctgcaagggcgtaccatggcatggaggcacctatgggtggacggcgtttcgctggtctgtcctgggctgagggctgagggctggacacccccacctggctcccgtgtcctgttgaagaggtgtcgaatcttcgccgctctcgagatgcacgtgtgcagctttggccgatcccctgttttcagctgcaactgtctcccgaagtcacagattcccccttggtctttggtgtgcggggagggctacaaatcctccccaagaatgcccaccctgcccccgactggggcagattctggttatccatag

SEQ ID NO: 154 - protein, 231 aa, Homo sapiens [sequence omitted]

SEQ ID NO: 155 - DNA, 264 bp, Homo sapiens
  CDS (1)...(264)
atgctgatgctgtttcttcagttgtattttgtcactctggctttcagagttctctatactctctcacaagccctgcctgacatccaccagcttccagaaaggagccccctttgccccagccgccgtttctcaacagtttctactgctgccattgctcagaggacacagcaacaaggagccatcttggaagcagaaagcagcccttaccagacaccaaacttgttagctcctcgatcttggatttcctggtgtctagaactgtga

SEQ ID NO: 156 - protein, 87 aa, Homo sapiens
MLMLFLQLYFVTLAFRVLYTLSQALPDIHQLPERSPLCPSRRFSTVSTAAIAQRTQQQGAILEAESSPYQTPNLLAPRSWISWCLEL

SEQ ID NO: 157 - DNA, 258 bp, Homo sapiens
  CDS (1)...(258)
atgctgactgccatgctttccctccttggctttctccaggcactcttcacacacagatgtgtctacagtggcaggtttgggagcctgaagagcggctgtgcccggtactgcaatgccactgtgaagaacgttggctccacaagcatgagccttcctctgtctgttcgcacagtgttagagccagtccagactccttggctacctccagacgtatgcagtagttcatcatgcctgcaagcggtaacgaaaacgatttga

SEQ ID NO: 158 - protein, 85 aa, Homo sapiens [sequence omitted]

SEQ ID NO: 159 - DNA, 624 bp, Homo sapiens
  CDS (1)...(624)
atggtccgctgcctggggcctgcgctgctgctgctgctgttactggggtcggcgagctcggtcggagggaaccgatgtgtggacgcggccgaagcctgcacggcggacgcgcggtgccagcgtttgcgctccgagtatgtggcgcagtgcctgggccgggctgcgcaggggggctgtcccgcgcccgctgccgccgggccctgcgccgcttcttcgcccgcgggcgcccgcgctcacccacgcactgctcttctgcccgtgcgccgcccggctgcgccgagcgtcggagcacccttcgtgccctcctgcgccttttcggggcccggccgcccgccctcctgccttgagcccttaaacttctgcgagcgacggaactgcaggatccccggcggcgcggccgctggcgaggcgcccagcgcccccgacggctgcctgctggaccagaggcgcccgctgcctgcgccctacgcgggcctcgtgggtacgcgcggccgggatccgggcgagggcgggggttctccaggggatatctccgccggcaccgccgtcacccctaactacgtggacaacgtgagcgcgcgtggcgccctggtgcgactgcggagccagcgggaaccggcgtga

SEQ ID NO: 160 - protein, 207 aa, Homo sapiens
MVRCLGPALLLLLLLGSASSVGGNRCVDAAEACTADARCQRLRSEYVAQCLGRAAQGGCPAPAAAGPCAASSPAGARAHPRTALLPVRRPAAPSVGAPFVPSCAFSGPGRPPSCLEPLNFCERRNCRIPGGAAAGEAPSAPDGCLLDQRRPLPAPYAGLVGTRGRDPGEGGGSPGDISAGTAVTPNYVDNVSARGALVRLRSQREPA

SEQ ID NO: 161 - DNA, 423 bp, Homo sapiens
  CDS (1)...(423)
atgtccaccaccacatgccaagtggtggcgttcctcctgtccatcctggggctggccggctgcatcgcggccaccgggatggacatgtggagcacccaggacctgtacgacaaccccgtcacctccgtgttccagtacgaagggctctggaggagctgcgtgaggcagagttcaggcttcaccgaatgcaggccctatttcaccatcctgggacttccagtctcttactcccccatcctgtttcttctgtcctttcagtataccttggacttggtcctggacatccattgctcctgctcccctgaattcccccctccaccaccccaactgtcctctcacaaatcttcctccaaacctcctcaagcccccaaattgaataaagattccacaagtctctgtaccaaacccagagcattctcatag

SEQ ID NO: 162 - protein, 140 aa, Homo sapiens
MSTTTCQVVAFLLSILGLAGCIAATGMDMWSTQDLYDNPVTSVFQYEGLWRSCVRQSSGFTECRPYFTILGLPVSYSPILFLLSFQYTLDLVLDIHCSCSPEFPPPPPQLSSHKSSSKPPQAPKLNKDSTSLCTKPRAFS

SEQ ID NO: 163 - DNA, 612 bp, Homo sapiens
  CDS (1)...(612)
atggtccggctctgccaggccctgctgctgttagtggccactgtggcccttgcatccagaagattccaagcctggggctcaacaaaggtggtgaggacattccaagatatccctcaaaactacgtctatgtgcagcaggcactctggttcgccatgaaggagtataacaaggccagctttagtataacaagttcagctttaggactgagtgctgctgcagagtttgtgcaatgtgagtgctggcgcaaggagcatctcatccccagcggcctggagccacacggcaatgagagaattccagtatacttggcaccagggctggttgctttccacaggtgcactcaggtgacagatagtttggagtactatattgaggtcaaaattgcccgaacaatttgcaagaaaatttcagaagatgaaaactgtgcatttcaagaggatcccaaaatgcaaaagtctcagaggtccaggctgctgctgcttcaggccaagatgggggacagccccagccaggccaggctgttttcagatggagactgtcacaaaggcaagttcatcacagaggagacaggcttaataaaaaagtcccttactctcctcgtagttgactaa

SEQ ID NO: 164 - protein, 203 aa, Homo sapiens
MVRLCQALLLLVATVALASRRFQAWGSTKVVRTFQDIPQNYVYVQQALWFAMKEYNKASFSITSSALGLSAAAEFVQCECWRKEHLIPSGLEPHGNERIPVYLAPGLVAFHRCTQVTDSLEYYIEVKIARTICKKISEDENCAFQEDPKMQKSQRSRLLLLQAKMGDSPSQARLFSDGDCHKGKFITEETGLIKKSLTLLVVD

SEQ ID NO: 165 - DNA, 534 bp, Homo sapiens
  CDS (1)...(534)
atgggtattcagaactcaccagcactcctcctgatggctgtcattgtgtttggcacatttgctgtaagtgtagacagtgacttgtacactgaactgcgctgcgtgtatgtgaagtcaacctttgtacttcatcccagaaacatccacaatttggagttggtctcagcaggaccccattgcagcaaagacgaagtaatgatggagcagtgcctaagtttaggctcctccaaaatgcagaatttgagtcatgagcctgccatgcagagggaggaaggacgttatgcaggatacaaaagaagaggtcatgttatacagccctggcttccacggacactaacactgaattcaaattttgacactgataatctgttgccaccaaatggaaaacgtaaacaaggtattctaagtgtgattagagaatatgcaaaacaaggaacaagtagaacattcttctctggaatccgagacgatggctgtactttcacagagagcatgatgttagatgtacatgaaataacgctaaaccgaaaatga

SEQ ID NO: 166 - protein, 177 aa, Homo sapiens
MGIQNSPALLLMAVIVFGTFAVSVDSDLYTELRCVYVKSTFVLHPRNIHNLELVSAGPHCSKDEVMMEQCLSLGSSKMQNLSHEPAMQREEGRYAGYKRRGHVIQPWLPRTLTLNSNFDTDNLLPPNGKRKQGILSVIREYAKQGTSRTFFSGIRDDGCTFTESMMLDVHEITLNRK

SEQ ID NO: 167 - DNA, 555 bp, Homo sapiens
  CDS (1)...(555)
atgctgagcaaaactgaacaagtgcagctgggaatggcgttggccctggctgccttgagcagaggcagatctgtcctggccttcctcctgatctctggtgaagatgcagaaggcaaatgcttagcattttatctgttctgcatcccaccggcgggcataattcccagcttagtctttgacaagtcttccaagcctcaggccccagagcccatgacgccagcacgctccttttggacggttgtttatgtcgtcgttatctatcagaacagcacctattacgatggaggtggctgccataacagccttaaggtgaccagcagccccgccattgccatcgccaccgccgccgccgctgccatggtctccgtggaccctgagaacctccggggcccgtccccctccagcgtgcagccgcgccacttcctgaccttggcacccatcaaaatacccctccggacgtcccccgtctcaggcatgcgtgtccatccactaactgtaacctgcacgcttcgtgacccagacatccttgtgaaatgcgtgtttcttcaaacttag

SEQ ID NO: 168 - protein, 184 aa, Homo sapiens
MLSKTEQVQLGMALALAALSRGRSVLAFLLISGEDAEGKCLAFYLFCIPPAGIIPSLVFDKSSKPQAPEPMTPARSFWTVVYVVVIYQNSTYYDGGGCHNSLKVTSSPAIAIATAAAAAMVSVDPENLRGPSPSSVQPRHFLTLAPIKIPLRTSPVSGMRVHPLTVTCTLRDPDILVKCVFLQT

SEQ ID NO: 169 - DNA, 552 bp, Homo sapiens
  CDS (1)...(552)
atggctctccgggtcagcctgtgtcttctcctccgtgcatcctcacttagctgtgctgcaccaggaaaccccatggctggaaaccgtaagctccccaaggaagaagggactacttcttaccacaagggtgaagatgagtcatttgtcaatacttcaacagaaaagaaaatgagtaaagattggaagtctgatgacagcatgcctgtctgtagctctggaaagggcatgggcatctcaacaggcatacaggagagccacaaagagcatctcagagaccaaggcacacgggactttgcattacttccaaaggtcatggtcaccgtcacaatttccatgaccttactcatgctggcaactctgcttgaaacgtccttaactcatcttctccacctggaaaaaatccaaacctttgatgaagtttggcactatggccatgacagcctccagataggagaagggtctggcttcattgacatttccacggtagtgcatacagccctcgagacctactcaagagaggacaaaagagaggctcgggtagagcttatctag

SEQ ID NO: 170 - protein, 183 aa, Homo sapiens
MALRVSLCLLLRASSLSCAAPGNPMAGNRKLPKEEGTTSYHKGEDESFVNTSTEKKMSKDWKSDDSMPVCSSGKGMGISTGIQESHKEHLRDQGTRDFALLPKVMVTVTISMTLLMLATLLETSLTHLLHLEKIQTFDEVWHYGHDSLQIGEGSGFIDISTVVHTALETYSREDKREARVELI

SEQ ID NO: 171 - DNA, 429 bp, Homo sapiens
  CDS (1)...(429)
atggagacctttcctctgctgctgctcagcctgggcctggttcttgcagaagcatcagaaagcacaatgaagataattaaagaagaatttacagacgaagagatgcaatatgacatggcaaaaagtggccaagaaaaacagaccattgagatattaatgaacccgatcctgttagttaaaaataccagcctcagcatgtccaaggatgatatgtcttccacattactgacattcagaagtttacattataatgaccccaagggaaacagttcgggtaatgacaaagagtgttgcaatgacatgacagtctggagaaaagtttcagaagcaaacggatcgtgcaagtggagcaataacttcatccgcagctccacagaagtgatgcgcagggtccacagggcccccagctgcaagttgggggttctttaa

SEQ ID NO: 172 - protein, 142 aa, Homo sapiens
METFPLLLLSLGLVLAEASESTMKIIKEEFTDEEMQYDMAKSGQEKQTIEILMNPILLVKNTSLSMSKDDMSSTLLTFRSLHYNDPKGNSSGNDKECCNDMTVWRKVSEANGSCKWSNNFIRSSTEVMRRVHRAPSCKLGVL

SEQ ID NO: 173 - DNA, 534 bp, Homo sapiens
  CDS (1)...(534)
atggctctcagcctctggcccctgctgctgctgctgctgctgctgctgctgctgtcctttgcagggggatcctctagagtcgacctgcaggcagcgagctcgcagcggaagtgtgagaggagagtttctgtgcccttctcccccgccaaaaagaaaacccaaagggcaagaagaaatttgggccaaaaatgcccaaaagctcgtcacctttttaaaaaatggggtccccgtcacaaaattgtgtccacccccaacacttcctgggggggccaaaggtctttggaaaaaagctttgccaaatcactcttagctttggacccacgctgggccgtctttggggactttacgggggtctccagtgggttaaccaaggaagacaaaggtttcgaagatccatctcaaggcctattggttataaagaggtttaagggttttaagttggggcctttccgattccggagggaacccgtcatcccgataaagcagttgggataccccaggggctctgctagaagctcaggccagggtggttga

SEQ ID NO: 174 - protein, 177 aa, Homo sapiens
MALSLWPLLLLLLLLLLLSFAGGSSRVDLQAASSQRKCERRVSVPFSPAKKKTQRARRNLGQKCPKARHLFKKWGPRHKIVSTPNTSWGGQRSLEKSFAKSLLALDPRWAVFGDFTGVSSGLTKEDKGFEDPSQGLLVIKRFKGFKLGPFRFRREPVIPIKQLGYPRGSARSSGQGG

SEQ ID NO: 175 - DNA, 468 bp, Homo sapiens
  CDS (1)...(468)
atgggtttgggctcgctgcttgctttttggccgggaagccggtgcgtcccgttggttgtggtttgggcctaccgccgggtgtggcgggtgggtgctggggtccccggggggggtggtctatttaaaaaaaaaaaaaagctcctcgttcggaaggttcgatcggccttaaagaacgcctgcatggtgggtctacaagtcattaaatcccagactgccagcggtcacagaagtcaggagaaagacctggaacagattctttctcagagtatcaacaaggaaccaatcctgcatgactccttggggtaccgagctcgaattcgtaatcatggcatcggcgcccgcgttgttccgggtttggctggtgttgttcggtcttctcggtgccggcgtatggcggccctagtttcgcgtcgcggcaccggcatttttgtgttgtacgaagcggaggaaaagaagactgcgtgctga

SEQ ID NO: 176 - protein, 155 aa, Homo sapiens
MGLGSLLAFWPGSRCVPLVVVWAYRRVWRVGAGVPGGGGLFKKKKKLLVRKVRSALKNACMVGLQVIKSQTASGHRSQEKDLEQILSQSINKEPILHDSLGYRARIRNHGIGARVVPGLAGVVRSSRCRRMAALVSRRGTGIFVLYEAEEKKTAC

SEQ ID NO: 177 - DNA, 288 bp, Homo sapiens
  CDS (1)...(288)
atgattttattacaccttctggatttggcaaagatcaacgctcaaagtgcgacggcctcttcgaattgggatcgccccaagcctaggaatcttatccctccgatttatgcgaacccgacaatgtacgtggagcgggaggttgctttaatccgaaacaaaccttccgtctgcctgcactgtcgtctaatacccgtcgaccagggtatatatcggcgaggacatcctcatgttcacaaggctggacggctgagctggacccgcgtggccgccaatgcttcgtactactga

SEQ ID NO: 178 - protein, 95 aa, Homo sapiens
MILLHLLDLAKINAQSATASSNWDRPKPRNLIPPIYANPTMYVEREVALIRNKPSVCLHCRLIPVDQGIYRRGHPHVHKAGRLSWTRVAANASYY

SEQ ID NO: 179 - DNA, 405 bp, Homo sapiens
  CDS (1)...(405)
atggtgtgcttcctcagagtgctgtggcttctcctcttgattctctcttctctgctaacccagaaaacccgcactgctgagaagaaatatggcacacaacagtttcttcctctgctccatgctggaccaagtggcttcatagctgcccagccagagacatcaacaacagccatgggtgccacagctaggagcttctacctggaacatccgttagcttttgagattctattttttgccttatatgtgagggactgcaatgtggaagaaaggaggagggaaacaccggccctgggcgccaggtctcctcctctagagctctccccagttgtgacgctcttattcaaggcgttctcccccccggacacagacttgcttcatcagcgtacagtgcaggctaaacagtga

SEQ ID NO: 180 - protein, 134 aa, Homo sapiens
MVCFLRVLWLLLLILSSLLTQKTRTAEKKYGTQQFLPLLHAGPSGFIAAQPETSTTAMGATARSFYLEHPLAFEILFFALYVRDCNVEERRRETPALGARSPPLELSPVVTLLFKAFSPPDTDLLHQRTVQAKQ

SEQ ID NO: 181 - DNA, 366 bp, Homo sapiens
  CDS (1)...(366)
atggcgacgcccaggggcctgggggccctgctcctgctcctcctgctcccgacctcagggccacaggcacccagtctgagcttgtctgggctggcgggcagccccagcgaatcacatgaggatgcctggggcggggggacagagaaccactctgaaacacactgtgccaaccaaaaggctccccggactgtcccagcagttctgaggagtgcctgtccccgttttacagacaaggagatggagggtgaccgaaaacaactcaaagcaatccaccaagcctctagtcagcagctgctgtgtgtcaactacccagaggaaacaggtgaaaaccaaatgtcaagactgggggcagaggccgtggcctag

SEQ ID NO: 182 - protein, 121 aa, Homo sapiens
MATPRGLGALLLLLLLPTSGPQAPSLSLSGLAGSPSESHEDAWGGGTENHSETHCANQKAPRTVPAVLRSACPRFTDKEMEGDRKQLKAIHQASSQQLLCVNYPEETGENQMSRLGAEAVA

SEQ ID NO: 183 - DNA, 693 bp, Homo sapiens
  CDS (1)...(693)
atggatgattgtgaagtaaatgacttacatgaaggggcaggagtgaaacggtccttcctgatcaccttggtgtctcctggtgcattaggagccaggtgtgatgtaagagaaggagagagaggtcttgtgaagactgagcgaggcttggtgaagcaactcgacaagagaaacgacctgtgcaaagggtggaccacagcccacacaggtgtgtgcaaacacaccgctcagcctgtcaggcatatttcctcagagaccctggcacggccaggccctcctcaccccaacaatacagaggagtggggtctggatgcacttaggcaagacctaaaccacagcagtaagacagcagctactccctgctgctacatctgtggacaagcaggtcatgaaaatgtgtcagacagtggtggcagctggattcctgattctgtgattttatcatcagctttgaagtatgaggaggcagctgtggctgccatactgggaccaggaagccaggtcaggaagctgctgctggccctggcacaggcagaggccacctcagcagaagccacatcactgctagagaggcagccaggaacattccagctcctcctcacttgccccgctggggcaatgcctgccactcctctgggtcgctccagacagctggtggccaaaaaggctgtcactcaccatcgtggtgaacactga

SEQ ID NO: 184 - protein, 230 aa, Homo sapiens [sequence omitted]

SEQ ID NO: 185 - DNA, 1416 bp, Homo sapiens
  CDS (1)...(1416)
atgaggcttctcctggtgctgctgcttctggctgctgtgtgtgctgccctggttggcccatatgatgctgacggtcagacagcacctgctgggagctggtcactgctcccaggatctaatgagggtgaccccttcattcccatcacagcccgagggcttagggattaccaggatccctacggagaagtggcggtaatgacacccctacagaacacctcctacaggacacccctacagaacacctcctataggacccccctacaggatactccctacagggcgtccctacagaacacctcctacaggatactccctacaggatactccctacaggacactctctacaggacaccactacaggacactccctacagaaaacccctacaggaaacctcctacaggacactccctacaggatactccctacagaaaacccctacaggaaacttcctacaggacactccctacaggatactccctacaggatactccctacaggaaaccctctacaggacactccctacaggacattctctacaggatactccctacaagaaaaccctacaagatactcctacagaaaacctctacaggacactccctacaggacactccctacaggaaacctcctacaggacaccccctacaggacaccacctacaggaaacccctacaggacacccctatatgacacccctacagtacaccccctataggacacctgaacaggacaccccctacaggacgctccctacaggacactccctacaagacactcttacaggaaacctctacaggacactccctacaggctccctacaggaaacccctacaggacctgccttacaggaaacccctacaaggcgctcctacaggaaacctccacaggacactccctacagaaaaccccctacaggacactccctacaggacaccccctacaggacactccctacaggacacccctacaggacacccctactggacacccctataggacactgtacaggacaccccctacaggacactccctacaggaaacccctacaagacactcctacaggaaacctctacaggacactccctacaggaaaccccctacgggacactccctacagggcaccccctacaggacacccctacaggacgatccctataggacacctgtacaggatatcccctacaggacactccctacaggacactctgcaggacgctcctacaaaacactccctgcaggacaccccctacaggacacccttacaggacactccctacaagacaccccctacaggacacccttacaggacacccctacaggacactccctacaagacatcccctacaggacactcgtacaggacaccacctacaggacacccctacaggacaccacctacaggataccccctatag

SEQ ID NO: 186 - protein, 471 aa, Homo sapiens
MRLLLVLLLLAAVCAALVGPYDADGQTAPAGSWSLLPGSNEGDPFIPITARGLRDYQDPYGEVAVMTPLQNTSYRTPLQNTSYRTPLQDTPYRASLQNTSYRILPTGYSLQDTLYRTPLQDTPYRKPLQETSYRTLPTGYSLQKTPTGNFLQDTPYRILPTGYSLQETLYRTLPTGHSLQDTPYKKTLQDTPTENLYRTLPTGHSLQETSYRTPPTGHHLQETPTGHPYMTPLQYTPYRTPEQDTPYRTLPTGHSLQDTLTGNLYRTLPTGSLQETPTGPALQETPTRRSYRKPPQDTPYRKPPTGHSLQDTPYRTLPTGHPYRTPLLDTPIGHCTGHPLQDTPYRKPLQDTPTGNLYRTLPTGNPLRDTPYRAPPTGHPYRTIPIGHLYRISPTGHSLQDTLQDAPTKHSLQDTPYRTPLQDTPYKTPPTGHPYRTPLQDTPYKTSPTGHSYRTPPTGHPYRTPPTGYPL

SEQ ID NO: 187 - DNA, 525 bp, Homo sapiens
  CDS (1)...(525)
atgaagacgctgtggctccttctgtctcttgctctgtttatctttcctttcttggcggtgtgttctggaagtggctgcatccctgactctgtggtggagtgtccggaaggggctgtctgccccacagctgcagctcccgaggcacccgcccctccaccatgctcacaggtccctttcatcccctccagccctaggagtgctctatccaaagaagtctggccaattggatgcagtacatcttttggtatgcagaaggtgaatctcataattggttctatttttccagtgtctgcattcctcctgaaggatgaagataactgctgtgtccctttcctgctcaatgaaactctgcaaatcctacgaagcccttttaccacatggggatttggtaaattatcaggcctagctaagtattggtccttagaatctagaagacaaagcagaaatgcccttctggcggggtgccacatggcaccagagctttgttccacagtggaatggcagtcggatgaagctgatgtctag

SEQ ID NO: 188 - protein, 174 aa, Homo sapiens
MKTLWLLLSLALFIFPFLAVCSGSGCIPDSVVECPEGAVCPTAAAPEAPAPPPCSQVPFIPSSPRSALSKEVWPIGCSTSFGMQKVNLIIGSIFPVSAFLLKDEDNCCVPFLLNETLQILRSPFTTWGFGKLSGLAKYWSLESRRQSRNALLAGCHMAPELCSTVEWQSDEADV

SEQ ID NO: 189 - DNA, 432 bp, Homo sapiens
  CDS (1)...(432)
atggccccgccgctcctgctgctgctgctggccagtggagcggccgcctgcccgctgccctgcgtctgccagaacctgtccgagtcgctcagcaccctctgtgcccaccgaggcctgctgtttgtgccgcccaacgtggaccggcgcacagtggagctgcggctggctgacaacttcatccaggccctggggccccctgacttccgcaacatgacgggactggtggacctgacactgtctcgcaatgccatcacccgcattggggcccgcgcctttggggacctcgagagcctgcgttccctccaccttgacggcaacaggctggtggagctgggcaccgggagcctccggggccccgtcaatctgcagcacctcatcctcagcggcaaccagctgggcgcatcgcgccgggagccttcgacgacttcctag

SEQ ID NO: 190 - protein, 143 aa, Homo sapiens
MAPPLLLLLLASGAAACPLPCVCQNLSESLSTLCAHRGLLFVPPNVDRRTVELRLADNFIQALGPPDFRNMTGLVDLTLSRNAITRIGARAFGDLESLRSLHLDGNRLVELGTGSLRGPVNLQHLILSGNQLGASRREPSTTS

SEQ ID NO: 191 - DNA, 357 bp, Homo sapiens
  CDS (1)...(357)
atgggtgtaggcacagcatccgtcctaaagaactgtctcttcctgggccctctggcttgggctctcctggtccccggaggactccaggcgggaaggacaccgggggtctccctggttacaccaggcatagggggggaggacacccttcggggggaaacccgtttttcgcgccggtattttttcggcgatcatcatcgagccttggcccactgggacaaacttactagttttacggatcttcagacccgggtaaacgggagactttgcacgcttatcagcgccctgatgttcatggttttacctcattcaaataaagtgataagtaagttcattcgagagggtttcaagcaaaaataa

SEQ ID NO: 192 - protein, 118 aa, Homo sapiens
MGVGTASVLKNCLFLGPLAWALLVPGGLQAGRTPGVSLVTPGIGGEDTLRGETRFSRRYFFGDHHRALAHWDKLTSFTDLQTRVNGRLCTLISALMFMVLPHSNKVISKFIREGFKQK

SEQ ID NO: 193 - DNA, 324 bp, Homo sapiens
  CDS (1)...(324)
atggttctcaaagtgccgacgtccaaagtcctgctagtcctggccaccttgttcgccgtggcggcgatgatcagcagctggatgccccaggtggcggccagtccgctcgcacccacggaatacgaacagagacgcatgatgtgctccaccggcctcagcgatgtgatacagaagatatgcgtaagcggaacggtggcccttggcgatgtatttcccaacagtttcgggaagcgcaggaagcgcgacttgcagaacgtaaccgatttgtgctgcaagtcgggtggctgcacctacagggagctcttgcagtactgcaaaggatag

SEQ ID NO: 194 - protein, 107 aa, Homo sapiens
MVLKVPTSKVLLVLATLFAVAAMISSWMPQVAASPLAPTEYEQRRMMCSTGLSDVIQKICVSGTVALGDVFPNSFGKRRKRDLQNVTDLCCKSGGCTYRELLQYCKG

SEQ ID NO: 195 - DNA, 498 bp, Homo sapiens
  CDS (1)...(498)
atgcgggaagcaggtggccttaaagacacaactggaaagctgtggaaatcatttctgctcccaagggcgctgctgccctctggtgcgcgagccgcctcccagcgcctgcacctgctcctggagacgctcaccttcccggctgttgccctaattctgcaacgtgtcaaaggacaaatgtcacatgtcatgtcttccctgccctgggacagccgcctctacctggcactcatctctggctcctcggcgtggatcagttactacatgatcatgctgtggagcatttcactgagtttcttctgggtgcctggattttgtgaccgtttggtggcctttaagaagagactttatgagagtcagttttgccagtacacctctggatataaagaaaatcaaaatataagttttgtcaacaagaactacttattatacaactacattggggctttttgcattttggctgtgctgacttatggaagcaggcatacactgggtgtgtga

SEQ ID NO: 196 - protein, 165 aa, Homo sapiens
MREAGGLKDTTGKLWKSFLLPRALLPSGARAASQRLHLLLETLTFPAVALILQRVKGQMSHVMSSLPWDSRLYLALISGSSAWISYYMIMLWSISLSFFWVPGFCDRLVAFKKRLYESQFCQYTSGYKENQNISFVNKNYLLYNYIGAFCILAVLTYGSRHTLGV

SEQ ID NO: 197 - DNA, 573 bp, Homo sapiens
  CDS (1)...(573)
atgctgggcctcctggggagcacagccctcgtgggatggatcacaggtgctgctgtggcggtcctgctgctgctgctgctgctggccacctgccttttccacggacggcaggactgtgacgtggagaggaaccgtacagctgcagggggaaaccgagtccgccgggcccagccttggcccttccggcggcggggccacctgggaatctttcaccatcaccgtcatcctggccacgagacggaaggagagccgccggaggagcacggggcacctgcgatcgcgaagagcctcctgttctggatgggagcgaaggctccgagaggacctaaggttgctcagtgggccatggaaacggcagtgattggggtggtggtggtgctgttcgtggtgactgtggccatcacctgcgtcctctgctgcttcagctgtgactcaagggcccaggatcctcaggggggtcctggccgcagcttcacggtggccacgtttcgccaggaagcttctctcttcacggggcctgttcgccatgcccagccagtgccaagtgcccaggacttctggaccttcatgtga

SEQ ID NO: 198 - protein, 190 aa, Homo sapiens
MLGLLGSTALVGWITGAAVAVLLLLLLLATCLFHGRQDCDVERNRTAAGGNRVRRAQPWPFRRRGHLGIFHHHRHPGHETEGEPPEEHGAPAIAKSLLFWMGAKAPRGPKVAQWAMETAVIGVVVVLFVVTVAITCVLCCFSCDSRAQDPQGGPGRSFTVATFRQEASLFTGPVRHAQPVPSAQDFWTFM

SEQ ID NO: 199 - DNA, 489 bp, Homo sapiens
  CDS (1)...(489)
atggcgctgcctccaggcccagccgccctccggcacacactgctgctcctgccagcccttctgagctcaggttggggggagttggagccacaaatagatggtcagacctgggctgagcgggcacttcgggagaatgaacgccacgccttcacctgccgggtggcaggggggcctggcacccccagattggcctggtatctggatggacagctgcaggaggccagcacctcaagactgctgagcgtgggaggggaggccttctctggaggcaccagcaccttcactgtcactgcccatcgggcccagcatgagctcaactgctctctgcaggaccccagaagtggccgatcagccaacgcctctgtcatccttaatgtgcaatgccgcgaatacctcctggttgtcctgtttgccctggaccgtgccaacccgccggccaatgtgactcgggatcgaccttgtttgcccagtgactgtgtacacctctga

SEQ ID NO: 200 - protein, 162 aa, Homo sapiens
MALPPGPAALRHTLLLLPALLSSGWGELEPQIDGQTWAERALRENERHAFTCRVAGGPGTPRLAWYLDGQLQEASTSRLLSVGGEAFSGGTSTFTVTAHRAQHELNCSLQDPRSGRSANASVILNVQCREYLLVVLFALDRANPPANVTRDRPCLPSDCVHL

SEQ ID NO: 201 - DNA, 1113 bp, Homo sapiens
  CDS (1)...(1113)
atgagaactaaaacccagcaactaagatttaggcaaagaaaacagattccagaatcagcacagagcctgctgctgctgctgctgcttctgtctgctgcttctgctgctggaggcattgctaacacactcacccaagccttagctcttaatagagacatgtttgcagctgaatgccccagtgcttgtggtttaagcaaaattgttaacactgtgcgaagttcatggccttctgccaatgccattgtacagtccctgagagaaaaaaggagaaagctccttgggataataaggcaggtgattctcagacccctcagtggagtttgtgggtggcggcagcagtggtggttagtgaggaaagcccgtcttcagggtatgtgcaaatgcaccacagctttgctgctgggggagggtggggttgctattagtggcagcagctgccgtcagttggctcttaggctctggggagcatgtgctttgggccttggtggtggctatcatggtgtcagtggtagcagtggggagtggcagcagcagggagagccagttctcaggcgcgcgctcaaatgcctgtgcttgcgtttaggaagcgacgagaatgggtggggtcaacacaatactactgctgcccgctcaaggttgacagagttaaatgatttgcagggaccaggcactgtggggggtgtatggctgttttctctggcctcgaaaaccattttctccagagccgaactacgctctaagcaccggaactaccttattagggataaatctcggtctaggatctcgccagaatctcgtgaactagtgctaaggcacagaacccattttggcacagaaacatactacttgaggtcgagaattctaaggggtaagctgaccctccatgtgatacccgttgcggctgtcagacagtatcttaccacaagcgaccttctaaatagcgtttttctatatgatgctggcggcagcccagtgagggaagtgcaacaagtatggttctcctgcttgtcaactgtggaaacagcgaccctgaaagtggaggagccacagctggaatcgtgtccgtctgaatacacgcacctttcctatgagccttgtaaagccagtcgttga

SEQ ID NO: 202 - protein, 370 aa, Homo sapiens [sequence omitted]

SEQ ID NO: 203 - DNA, 279 bp, Homo sapiens
  CDS (1)...(279)
atggagttgtggtgggagtgggcattgctggccactctcctggtgcttgttgcagggagccagaaaatatgtcagagtatagaggaccccccatacaatttaaagaataaggaggaggaggaggagaaggaggaggagggagaggagaaggtagaacataacgtttccatccaggttaagaaacagccaggccttggtcttctgctcctggacatcccggccttcactgaccaccgtctgaacaggtccgagccctgctctaccctgtgctttgcttga

SEQ ID NO: 204 - protein, 92 aa, Homo sapiens
MELWWEWALLATLLVLVAGSQKICQSIEDPPYNLKNKEEEEEKEEEGEEKVEHNVSIQVKKQPGLGLLLLDIPAFTDHRLNRSEPCSTLCFA

SEQ ID NO: 205 - DNA, 657 bp, Homo sapiens
  CDS (1)...(657)
atgcgagacaaagcagcccctgcctggacagtgctggccctgatgcaaggggtgcaggcaaagaaggagaggccctcttggcttcgggatgcagttctctgctccaccacaccagtgcccagggcctttcccatggcaaagcaccaacacctgcccttatttaaaagcttatctgtagcccagcagaaaacaaggcacgacacatatttgaggtttaacatcttgattctcaggctttataacactggatattattggcaacaccatgaaacaaagaaacagaagcttctgcccactcctccacatgtgacattaggaattcagtgtaggacagtgaaggacaaatcactacacctgagttctgctatcttggttctttctgtgaccaaacagtctgtacgccccctgcagaggaaccagcatctggctgacatctccacaggcgcagcaaccacctgctggccagaagaggtaacattagtagcatattcagttcacaccgaacgtcattatgaaaatcagcagaacggaacaccagaaaggtccagtgacaggccccgaggtcacagggcagggaaattagctaatgaacttatttctgctgatgttcacgtctgcaccttctaccctactcccaagccctgtgcaggcttttaa

SEQ ID NO: 206 - protein, 218 aa, Homo sapiens
MRDKAAPAWTVLALMQGVQAKKERPSWLRDAVLCSTTPVPRAFPMAKHQHLPLFKSLSVAQQKTRHDTYLRFNILILRLYNTGYYWQHHETKKQKLLPTPPHVTLGIQCRTVKDKSLHLSSAILVLSVTKQSVRPLQRNQHLADISTGAATTCWPEEVTLVAYSVHTERHYENQQNGTPERSSDRPRGHRAGKLANELISADVHVCTFYPTPKPCAGF

SEQ ID NO: 207 - DNA, 354 bp, Homo sapiens
  CDS (1)...(354)
atgagcccaggctatttgctgctgctgctgctgttggagtcacctgttgctggaaggaactgtgccactgtactacaccagaacagctgccatctccatgacaacaagcacgcgctggtgctgcctgcctggaggggagaagagcacagagaaggcattagctactgccctcccagacgcaggacaagcgacagaatttccaacagcatcggctactacggcaacacctttttactcttgtgcaccaaactggccgacatctcggaacaaggaggggactggccttcccagatccacaatgccgcggaagcagagccagccgcctctccactctccgccaaccgcgacaagtaa

SEQ ID NO: 208 - protein, 117 aa, Homo sapiens
MSPGYLLLLLLLESPVAGRNCATVLHQNSCHLHDNKHALVLPAWRGEEHREGISYCPPRRRTSDRISNSIGYYGNTFLLLCTKLADISEQGGDWPSQIHNAAEAEPAASPLSANRDK

SEQ ID NO: 209 - DNA, 693 bp, Homo sapiens
  CDS (1)...(693)
atgggctccccggccaccgccgccaccgggctcctcctcctgctgctgctgctgctgctgctgccgccgcggctcggccgggagagaaaagggctgagggaaacgtggtcccttatattactttcagccgtgggttgtcctgagctgatagcacgcgatgatcgatggttggaccttaactgccgtactcatagtggagacactatcgcatacccgttgtcgtgttcgactaatcccgttcgcggcggccttgtcaacaacgtgccctttggtcctccatcacgaatgtgcagtcattcgatggctgagggcaagatcacacactttgtcgtttcttctactttggtggatgtgcctcagtgcccgcatggtgcactccttgcaggtctcctactgtgcctccccaaggccactggaagaacccaaactgccatcggatttcagagtgtcggcgtctgcgtaagattacgctccattaccagtagttggcaagttcatacgggccgccattggcacgccatggagggttactacagagataatcctggctctaaatcatcggtgacggggacagtctacgacatgacatcctccagaaaatccaccgtgttggtaaaggtgctcaaaagacggaatgctatctctcgctcgcaatggtgtctttctcgagaggctatagaaggcagaaaatag

SEQ ID NO: 210 - protein, 230 aa, Homo sapiens
MGSPATAATGLLLLLLLLLLLPPRLGRERKGLRETWSLILLSAVGCPELIARDDRWLDLNCRTHSGDTIAYPLSCSTNPVRGGLVNNVPFGPPSRMCSHSMAEGKITHFVVSSTLVDVPQCPHGALLAGLLLCLPKATGRTQTAIGFQSVGVCVRLRSITSSWQVHTGRHWHAMEGYYRDNPGSKSSVTGTVYDMTSSRKSTVLVKVLKRRNAISRSQWCLSREAIEGRK

SEQ ID NO: 211 - DNA, 307 bp, Homo sapiens
  CDS (1)...(307)
atgctcctgctgctgctccttgaaacactggctgtgtttgcactgaggccatgcctcagccagcgactgagtgtgacaaggattctcagtcctgttcctgggagatgtgagattcctttgctggcaaacttcagcttgaatattccccaggttagccaattcccagagataatacaacaacttgctacactagcatgcttttcaggttcaaatctaccaattcaaagcccttacacccaaccacctactttatctggctcttgcactctgggtcactatccacttgccctaatcacctcaggaccag

SEQ ID NO: 212 - protein, 102 aa, Homo sapiens
MLLLLLLETLAVFALRPCLSQRLSVTRILSPVPGRCEIPLLANFSLNIPQVSQFPEIIQQLATLACFSGSNLPIQSPYTQPPTLSGSCTLGHYPLALITSGP

SEQ ID NO: 213 - DNA, 615 bp, Homo sapiens
  CDS (1)...(615)
atgtcacctccaagcacctcctggggttgcctgtcctctctcctcttcctgctgagcccctgggtccaaggacctcccaccttcaaaaaagtaaaaacagcacagcccagacccaggggtaaaattcatgtcatcacttcttcctgggccagcacccaaatacctcctgagccacaggaacacgatgcctctgtggccctgacagccactgccgattgtcctgggaggggccttcagggaaccgcacaggaaggagggtgcagctcagcccgttttcaaatccagcaggatgttcatgacctccctgcagacactaatggacagaacgtcacagcagtctgcttccctcacctgtacgggggttaccccagatcacccccagtcaccgactgcatgcaaatctctgtctcagagtttggtcccagcacattcaacctagggcatgtaggaccaccctcgtttcacgataaacaaccaaaacagggcagttacgtgatgtgcgtaagatggcacgactcacacgtgccgcagctggaacttaaactccatccggactccaaggccaccctgttgtctctccacaatcaatgctcagagcacagcctgcaactgtaa

SEQ ID NO: 214 - protein, 204 aa, Homo sapiens [sequence omitted]

SEQ ID NO: 215 - DNA, 483 bp, Homo sapiens
  CDS (1)...(483)
atgcctgatgtctggggtccagctgctgctgccagtgctgcctcttctgctgccaaccccactcttttcatcctcctgctgcttccaccaacatttctgctgccatcgccaaaattacagatgctgccagcactgcagctttgcttcccccctgctgtcttgttgctgcattgccatggcatcaggcaagggttcaggggcctaggcaaatggactgtggcacttgtatgtctccctcctggaaaatgcaggctatccaataaaggggagagaggaacagggcagagcactataaaaggcaaacaccgtggtgaaatttgcagcaccatccggctgccaaatttagcatccaggtcactggtgccacggaaagcgttgccactgatgcttgtgccgggaaaggcacctctcctctgcttcagtgtccatgctaagggaaacctaatgcctcacactgacaaaaatgcacccagtggatcttaa

SEQ ID NO: 216 - protein, 160 aa, Homo sapiens [sequence omitted]

SEQ ID NO: 217 - DNA, 240 bp, Homo sapiens
  CDS (1)...(240)
atgaccaacagattcttgctcctgttatcttctttccagcaggtctatggggaccgtaaaactgttaaagacttttgttcaggctccctcaacagtgaaatgatgtcccctccccccacatctgtgttgatctactttactctcaatcggtgcatccttccacatgggaaaatggaatatagggcatcagtgcattctctggttgtagcttcttgcttatatcatcaaggaaatgattag

SEQ ID NO: 218 - protein, 79 aa, Homo sapiens [sequence omitted]

SEQ ID NO: 219 - DNA, 681 bp, Homo sapiens
  CDS (1)...(681)
atgaatctgcagcaccagcccctgccagtctcccacagccagggtggccaagccctcagggctctgcaggacaatcctcggcgtctgctgctgctgctgctgctgctggaaccttctcagggtgtcctctgctggcaggcaggcttcgcacacagcctctgccagggctgtgcacagcaggcagcaccaggccacagcattgactggctatttgtgcaacgctggttgaagacgccagtgacctggaaaagggcccaagccaggccgcggccgcggctcctcgactcctccggtcacctggccccagcctgggaccgctcccgcctccagccgctggaaagcatctccaggctggtggcgcggactttcatggaaacatcacctctcttcaaaggatccttggatcccccaaaagagaacaccagctctgggatcgccaggccctggctcagctctccaccctgtaatgaaatggccagctatctgggacattactgtagcctcctcgccatcagaactgtcactcccgctgccatcatcctctccttcagcaccatctccattctcatcactcgcatcaccaccacctcacacagaaccatctgcatccttctgctcacccagtggaccctcttctccctgtacccagggaggaaccctatcagcatttgctgcctttga

SEQ ID NO: 220 - protein, 226 aa, Homo sapiens [sequence omitted]

SEQ ID NO: 221 - DNA, 441 bp, Homo sapiens
  CDS (1)...(441)
atgacaaggcttttttggctgtgtgtgtccagctgttccatgccaggaggaggaggagttacatgctggaagcttgcagatagcctggggctgctgctcgccttgctgcggttggtggcagctaccgagactacctcgcaccagagcggcctggccgggcaggccccgcagcgctcctactccctcttcccggcccctggacttgcggctgctgccacaactagcgcagatgtcactataaccatcgctgctgttgccctcaatgcactggcccaccctacaaagctcctactacctggccaccgccgcagccctgcccctgccatggccacagctggccgtcctcctaccgctctggtgcgaggtagtctcggtagctgccaccaaccgcagcaaggcgagcagcagcccctaggctatctgcaagcttccagcatgtaa

SEQ ID NO: 222 - protein, 146 aa, Homo sapiens [sequence omitted]

SEQ ID NO: 223 - DNA, 576 bp, Homo sapiens
  CDS (1)...(576)
atgaaggcatcctgggtgcacctggcgctctgcctggcccacagcgcacgtggggcagacctcaggccgcagtcacggggctgctcaggtgctgcgatgggagaagagccaggaagtgagtctccacccagtgccgctcagtcacgggacccagaactcactgaaccgcccacgttaatgacgcgcagttcgccgtgtgccaatgacgcctcaatcaagctgctaaacgaaggccggagcagccctgcctgtggggctgtaatgttttctgcagccttgatgagccgccctgggctgtttcaaagggaacgcagcagtctcctcttgacttccgcagtggccgtattcctgggccgtgcggtaaacagggagtatctaggctcggatggttacagacggctttccccgtgggcggcgtcccgtgggccctatgcaagctgcgcaggccgccctgggctctgccgcgagtgcgtgggcggcaggacggtgcatcccgggcctccaccggtcaaatgctccacactgaccaccgcagcacccccccgctctcccgggcaaattctaaagcttccctag

SEQ ID NO: 224 - protein, 191 aa, Homo sapiens
MKASWVHLALCLAHSARGADLRPQSRGCSGAAMGEEPGSESPPSAAQSRDPELTEPPTLMTRSSPCANDASIKLLNEGRSSPACGAVMFSAALMSRPGLFQRERSSLLLTSAVAVFLGRAVNREYLGSDGYRRLSPWAASRGPYASCAGRPGLCRECVGGRTVHPGPPPVKCSTLTTAAPPRSPGQILKLP

SEQ ID NO: 225 - DNA, 870 bp, Homo sapiens
  CDS (1)...(870)
atgaacagtgctttcttgttgctttttgcttgtatcctcacagcccttctttccgcttcctgcctctttaagggcatagataatacagaagcagaaaagcgagacccccaggaactcgtggcctccttttctgaaagagttcggaacatgtcgcctgatgaaatcaagatcccgccagaaccccctggcagatgttcaaatcacttgcaaaatcacgtcaccctccgtgccagacaaccagacaacaagctccagcctctaacaggtccatctccctgggagagtggagggccatcaggaagcttgcttagagcagctgagctggatttaaaagttgtgaaggttttgtgtcagccccaggagctggatggttcaggtcccatgcagggacgtggacttgtgcctgctcagcgccggcactgttctttcagcatctacgagaagctgatccagttctgtgccattgacgagcttggcaccaactacccaaaggatatgtttgatccccatggctggtctgaggactcctactatgaggcattagccaaggcccagaaaattgagatggacaaattggaaaaggccaaaaaggagcgaacaaaaattgagtttgtgacgggcaccaaaaaaggcaccacgaccaacgccacgtccaccaccactaccactgccagcacagctgttgcagatgctcagaagagaaagagcaagtgggattcggctatcccagtgacaacgatagcccagcccaccatcctcaccaccacagccaccctgccagctgttgtcacggtcaccaccagcgccagcggctccaagaccaccgtcatctctgctgtgggcaccattgtgaagaaggccaagcagtga

SEQ ID NO: 226 - protein, 289 aa, Homo sapiens
MNSAFLLLFACILTALLSASCLFKGIDNTEAEKRDPQELVASFSERVRNMSPDEIKIPPEPPGRCSNHLQNHVTLRARQPDNKLQPLTGPSPWESGGPSGSLLRAAELDLKVVKVLCQPQELDGSGPMQGRGLVPAQRRHCSFSIYEKLIQFCAIDELGTNYPKDMFDPHGWSEDSYYEALAKAQKIEMDKLEKAKKERTKIEFVTGTKKGTTTNATSTTTTTASTAVADAQKRKSKWDSAIPVTTIAQPTILTTTATLPAVVTVTTSASGSKTTVISAVGTIVKKAKQ

SEQ ID NO: 227 - DNA, 822 bp, Homo sapiens
  CDS (1)...(822)
atgcgccttcccggggtacccctggcgcgccctgcgctgctgctgctgctgccgctgctcgcgccgctgctgggaacgggtgcgccggccgagctgcgggtccgcgtgcggctgccggacggccaggtgaccgaggagagcctgcaggcggacagcgacgcggacagcatcagcctcgagctgcgcaagcccgacggcaccctcgtctccttcaccgccgacttcaagaaggatgtgaaggtcttccgggccctgatcctgggggagctggagaaggggcagagtcagttccaggccctctgctttgtcacccagctgcagcacaatgagatcatccccagtgaggccatggccaagctccggcagaaaaatccccgggcagtgcggcaggcggaggaggttcggggtctggagcatctgcacatggatgtcgctgtcaacttcagccagggggccctgctgagcccccatctccacaacgtgtgtgccgaggccgtggatgccatctacacccgccaggaggatgtccggttctggctggagcaaggtgtggacagttctgtgttcgaggctctgcccaaggcctcagagcaggcggagctgcctcgctgcaggcaggtgggggaccgcgggaagccctgcgtctgccactatggcctgagcctggcctggtacccctgcatgctcaagtactgccacagccgcgaccggcccacgccctacaagtgtggcatccgcagctgccagaagagctacagctttgacttctacgtgccccagaggcagctgtgtctctgggatgaggatccctacccaggctag

SEQ ID NO: 228 - protein, 273 aa, Homo sapiens [sequence omitted]

SEQ ID NO: 229 - DNA, 453 bp, Homo sapiens
  CDS (1)...(453)
atggtggtatttaccttgctgctggtgctgctgttgttgctgctgctaacagctctatgtaaggctctgagtcaaagccttccctataccctctacaggccacagtcatcactatccttcctccttatcactgatataaaaaagattgatatacagtattttctcccattgacaggtggcaagtgcctgcatcttcgcttgacaggacagagggctttctgtatcctggagttcttgccttggtgtaatggaataattgaatcactcgtgggcttggagaatgagcgcaaggttttgagtggaggtagctctcagcagatgggggaagccagaaggggaatggagtgggaagtttttcccctggagttgggccgcccagaggccggggctctccaacgactgccccagccaaactccgcgttgttggcttgccggtgtgctggtgcctattag

SEQ ID NO: 230 - protein, 150 aa, Homo sapiens
MVVFTLLLVLLLLLLLTALCKALSQSLPYTLYRPQSSLSFLLITDIKKIDIQYFLPLTGGKCLHLRLTGQRAFCILEFLPWCNGIIESLVGLENERKVLSGGSSQQMGEARRGMEWEVFPLELGRPEAGALQRLPQPNSALLACRCAGAY

SEQ ID NO: 231 - DNA, 768 bp, Homo sapiens
  CDS (1)...(768)
atgcgcccccgagccccagcctgcgccgccgcggcgctcgggctctgcagccttctgctgctgctcgcgcccgggcacgcgtgccccgcgggctgcgcctgcaccgacccgcacaccgtggactgccgcgaccgcgggctgcccagcgtgccagaccctttccccctggacgtgcgcaagctgctggtggccggcaaccgcatccagcggatccccgaggacttcttcatcttctacggcgacctggtctacctggacttcaggaacaactcgctgcgctcgctggaggagggcacgttcagcggctcggccaagctcgtgttcctcgacctcagctacaacaacttgacccagctgggcgccggcgccttccgctcggccgggaggctggtgaagcttagcctggctaacaacaacctggtgggcgtgcacgaggacgccttcgagaccctggagtcgctgcaggtgctggagctcaacgacaacaacctgcgcagcctcagcgtggccgccctggccgcgctgcccgcgctgcgctccctgcgtctggacgggaacccctggctgtgcgactgtgacttcgcccacctcttctcctggatccaggagaacgcatccaaactgcccaaaggactggcgggtgtggattacttatgcgtccctggtaagcggaatgcagcctactctatgggaaacggccgtattctcagtaccgtgcacggggagtcagccagttccaagggctctccagcagcttcccgagcctaa

SEQ ID NO: 232 - protein, 255 aa, Homo sapiens
MRPRAPACAAAALGLCSLLLLLAPGHACPAGCACTDPHTVDCRDRGLPSVPDPFPLDVRKLLVAGNRIQRIPEDFFIFYGDLVYLDFRNNSLRSLEEGTFSGSAKLVFLDLSYNNLTQLGAGAFRSAGRLVKLSLANNNLVGVHEDAFETLESLQVLELNDNNLRSLSVAALAALPALRSLRLDGNPWLCDCDFAHLFSWIQENASKLPKGLAGVDYLCVPGKRNAAYSMGNGRILSTVHGESASSKGSPAASRA

SEQ ID NO: 233 - DNA, 615 bp, Homo sapiens; identical to SEQ ID NO: 213
  CDS (1)...(615)

SEQ ID NO: 234 - protein, 204 aa, Homo sapiens [sequence omitted]

SEQ ID NO: 235 - DNA, 597 bp, Homo sapiens
  CDS (1)...(597)
atggctctcagcttttggcccctgctgctgctgttgctgctgctgatgctgctgtcctttgcagtgactctggcccctactgggcctcattccctggaccctggtctctccttcctgaagtcattgctctccactctggaccaggctccccagggctccctgagccgctcacggttctttacattcctggccaacatttcttcttcctttgagcctgggagaatgggggaaggaccagtaggagagcccccacctctccagccgcctgctctgcggctccatgattttctagtgacactgagaggtagccccgactgggagccaatgctagggctgctaggggatatgctggcactgctgggacaggagcagactccccgagatttcctggtgcaccaggcaggggtgctgggtggacttgtggaggtgctgctgggagccttagttcctgggggcccccctaccccaactcagcccccatgcacccgtgatgggccgtctgactgtgtcctggctgctgactggttgccttctctgctgctgttgttagaggaccaattttccctttgcccctcagggaccccccttctgttctaa

SEQ ID NO: 236 - protein, 198 aa, Homo sapiens
MALSFWPLLLLLLLLMLLSFAVTLAPTGPHSLDPGLSFLKSLLSTLDQAPQGSLSRSRFFTFLANISSSFEPGRMGEGPVGEPPPLQPPALRLHDFLVTLRGSPDWEPMLGLLGDMLALLGQEQTPRDFLVHQAGVLGGLVEVLLGALVPGGPPTPTQPPCTRDGPSDCVLAADWLPSLLLLLEDQFSLCPSGTPLLF

SEQ ID NO: 237 - DNA, 327 bp, Homo sapiens
  CDS (1)...(327)
atgctgctgctgctgctgctgctgctgctgctactgctgctattaccacgtgagcccacctttgtgctaatcaagactcgcatcactgccttaaaaagtgggcatcctaaaacgtccaaggaaaacatcaggggacatgagatgtcagatggccctcacaaccaagcactctgtcttgaagcactagctaagctgcgaatcaagctgcttatttggttaggagaacctgtgaaagaccatagcttgcatgccctgcggttcgactctagaagatcccccccagcaggccagattgtagtagttcccaactttggctgcacattgtaa

SEQ ID NO: 238 - protein, 108 aa, Homo sapiens
MLLLLLLLLLLLLLLPREPTFVLIKTRITALKSGHPKTSKENIRGHEMSDGPHNQALCLEALAKLRIKLLIWLGEPVKDHSLHALRFDSRRSPPAGQIVVVPNFGCTL

SEQ ID NO: 239 - DNA, 456 bp, Homo sapiens
  CDS (1)...(456)
atgcctgcttcagacaccagcccccttcttcgcctcatcgcactgagtagtaacatcattgcaattgtttttctaatagactgctgtgtctgcccactagatttcaagctctctaaagaggcccacgatagtgtcactcaaatcctctccagacagccctttggaaacatattccatgttcctcttcttagggatgtgggtaggagtgggggtggagatggttctgtaaagcttgaggagcaagtgaatacatatcactatcagcgaatattgttgggaatatcatcggataatgcaatcctcttagaggaagaatctgaggagggacgacccatgcatataagcaccatcaaagagccatcacctgattccccaatcttatacctgacgctgaatctcaaactccttacctcgcgtgaggagggagtttactcccgagccacaagaaagtggtga

SEQ ID NO: 240 - protein, 151 aa, Homo sapiens
MPASDTSPLLRLIALSSNIIAIVFLIDCCVCPLDFKLSKEAHDSVTQILSRQPFGNIFHVPLLRDVGRSGGGDGSVKLEEQVNTYHYQRILLGISSDNAILLEEESEEGRPMHISTIKEPSPDSPILYLTLNLKLLTSREEGVYSRATRKW

SEQ ID NO: 241 - DNA, 579 bp, Homo sapiens
  CDS (1)...(579)
atgtatagcgccgattttggcctgcttgcactgctaccgctgccgagccaaggcgcgccgatggccacgacgcccttaccgggcgcccctaccccatgggatgttgcgattacaaccaactggaccggcgcttaccgcaaagaatatgccctgcacgcggcttgtaccgggcaacaaaaaacaaaaatacaaaaacgcgtgcgcatagctatacatgtttgcctgcgtactgcaccactggataacctatgtacaggatttgctgtaaacccgccttggccacctgccgaacttacgctttccctgcaattcgcagttggcttacaccttgtgaccggggggttacctatagtaggggggagtgagggaagtttgccacacgaccacactcttacagcaattgctagtaacccgcctacgccagccgcggaactaccgcttacccgccacggcgaacgagaaagacgcaggcagctgcctgctgttagtcgactctacgaggatccccaccctcctctaggggcactcaatgaaagaaccgggaagcgccctgatatgactgtggttggactgacctga

SEQ ID NO: 242 - protein, 192 aa, Homo sapiens
MYSADFGLLALLPLPSQGAPMATTPLPGAPTPWDVAITTNWTGAYRKEYALHAACTGQQKTKIQKRVRIAIHVCLRTAPLDNLCTGFAVNPPWPPAELTLSLQFAVGLHLVTGGLPIVGGSEGSLPHDHTLTAIASNPPTPAAELPLTRHGERERRRQLPAVSRLYEDPHPPLGALNERTGKRPDMTVVGLT

SEQ ID NO: 243 - DNA, 351 bp, Homo sapiens
  CDS (1)...(351)
atggctcgcagacactgcttctcctactggttactggtatgctggttggtggtaactgtggcagaaggacaagaagaggtatttacgcctcctggagattcacaaaataatgcggacgctaccgactgccagatctttacactcacccctccacctgccccgaggagtccgttctgctcagagaaaggccctgtcctgctgctgggccttgaggaagccaagattctctgcaatgactgtaatggacgatccactgttcagtttcatatattaggcatgaaatgtaagatttgtgaatcctataatactgctcaagctggaggacgtagaatttcactggatcagcaatga

SEQ ID NO: 244 - protein, 116 aa, Homo sapiens
MARRHCFSYWLLVCWLVVTVAEGQEEVFTPPGDSQNNADATDCQIFTLTPPPAPRSPFCSEKGPVLLLGLEEAKILCNDCNGRSTVQFHILGMKCKICESYNTAQAGGRRISLDQQ

SEQ ID NO: 245 - DNA, 327 bp, Homo sapiens
  CDS (1)...(327)
atgctcctgctgctgctccttgaaacactggctgtgtttgcactgaggccatgcctcagccagcgactgagtgtgacaaggattctcagtcctgttcctgggagatgtgagattcctttgctggcaaacttcagcttgaatattccccaggtacaatgggatacccgtggctacactctatcacatctcttcattcatcttctcagcaactctccattgaacacttacactgttctagacactcaagaaagagcactccttaaggcagacaaagttgcctgccctcaagaagctactattctagtgaaagaagacaaacaaaaataa

SEQ ID NO: 246 - protein, 108 aa, Homo sapiens
MLLLLLLETLAVFALRPCLSQRLSVTRILSPVPGRCEIPLLANFSLNIPQVQWDTRGYTLSHLFIHLLSNSPLNTYTVLDTQERALLKADKVACPQEATILVKEDKQK

SEQ ID NO: 247 - DNA, 438 bp, Homo sapiens
  CDS (1)...(438)
atgagtttgctgttgctgctgctgctgctgctgctgctgtttaaatggaaaagaagagtagtaagtggtcatcttctcagcgtctggtgctggtcccgcccacacactgtggcagagcagacccacctgttgtcactgggaaatgaggggctgcaggtactgcccttagacaatggagaggcttctggactgtcactccaacttggaatcaaatggaccactgagaaacccgtggaagacagcaggtctaaggaaatcacaaagattagaaatgcatccatgtgcacccaactccctcctagtgtgggtgggggcacctgcaatagtctctggtacacgagagttgttcaagaaatagtcctgcatgaaagatcagaagagaaatggagagactcccgaagtgggaagttcacatttcaggacgtgagaaaacgctga

SEQ ID NO: 248 - protein, 145 aa, Homo sapiens [sequence omitted]

SEQ ID NO: 249 - DNA, 552 bp, Homo sapiens
  CDS (1)...(552)
atgaaagtggtggtggtgatggtggtaatactggtggtggtgacattggtggtggtggtgatggtggtgatactggtgatggtggtgatggtggtggcgctggtgaccctgacatggggtccagtagcagtgacagtggatgcaggctcctgtctctcagcaaacctgctgggcgacagcggactcagatgccttctggaatgtctgccgcaggtgcccatctccggtttgcttgacctgggctctgagcagagcttccggattcacttctccagagaggaccaggctgggaagacactcaggctaagtgagtgcagcttccggccagagcacgtgtccaggctggccaccggcttgagcaagtccctgcagctgacggagctcacgctgacccagtgctgcctgggccagaagcagctggccatcctcctgagcttggtggggcgacccgcagggctgttcagcctcagagacaactgcagagctacaaagacagcacatccacaaatggagaccatcacatcatcgacaatagcagcttctgtttactaa

SEQ ID NO: 250 - protein, 183 aa, Homo sapiens [sequence omitted]

SEQ ID NO: 251 - DNA, 546 bp, Homo sapiens
  CDS (1)...(546)
atgaaaacattggatcggaaggttttcttcctgtcttcactgctcattggactttcaggactggaagagcccctctaccttaaatttagagttacaggttcattggaaagagcatcaacccaacctgcttacatcagagacctgaacactcagtgtgactgtgcgaactccccgtacaggacatttattaatgctagtatgcactttctccctcttagtaataacattccagagtcctcttggggagaaatctccattgactttgtggaactgcaaggcaaggtgcctagttctccaatcaccaagatgtgcacacatgacccattggccaagtggacactctctcccaaatcttcgaatctcaagcagatggatgcaaggatggaaaacagctggaatcgactcatttcagtgggatcagaaagggcagccacagagttaggtgagaaggcacagctgaagcgatggaagatttacatcatatctgtcagcatgtcaataacccatcctgaaattcaggaaaggctgaaaaactgtctaacttga

SEQ ID NO: 252 - protein, 181 aa, Homo sapiens
MKTLDRKVFFLSSLLIGLSGLEEPLYLKFRVTGSLERASTQPAYIRDLNTQCDCANSPYRTFINASMHFLPLSNNIPESSWGEISIDFVELQGKVPSSPITKMCTHDPLAKWTLSPKSSNLKQMDARMENSWNRLISVGSERAATELGEKAQLKRWKIYIISVSMSITHPEIQERLKNCLT

SEQ ID NO: 253 - DNA, 426 bp, Homo sapiens
  CDS (1)...(426)
atgaggccccggaaagccttcctgctcctgctgctcttggggctggtgcagctgctggccgtggcgggtgccgagggcccggacgaggggctcccactgtcttctggcatttgcttcctaaactacaacccagccagctccactgcttacttcttggacattgttgtccagccccttggaaaacagttggaacagccgttgggctctgagcaacaaggcccttttatttcagttagatgctgggctcgggacctgcagcccgccatgcctgagcttcccacccactccatgggctcctgtgcggcccgagcctccccgacgagcgccaccccctgctccacggcgcccagtcccatcgaccacccaagggctgaggagtgcgagcgcacggcgcgggactggcagcctgcagatggcctactgtga

SEQ ID NO: 254 - protein, 141 aa, Homo sapiens [sequence omitted]

SEQ ID NO: 255 - DNA, 942 bp, Homo sapiens
  CDS (1)...(942)
atggaggattatatacataagctcgtttatacagtgtttgcttgtgggaggcaccctgctctcctccttctctttgtccctgtgctgccgagtgccggttcgtcgccgctgcctggccatgtcttaagcatcttttctcctcccgcgcgcataccgcatgcccgttcggtgtcctcccagctcttcccgtatgcagccgttgccagcttcggaccctccctgcgggtagtggagtttttagagagactccttctcgtccgtgctgctgatcggagctgtcgcagccgtttcgctcctattcgcgaccgaggtctccgcagctcgcgctgtcgcacagatctccgtgtcagcggctggcatggcctccctctcgatttgcctaaagagtatacatatgcttgctatataaactgcactgcctctgccggaattgtcaccgagatgctcaggcctttcatcactcttgtgtctagagccgccaggtggtcccaggaccccttttcacctagcagttccgcagcccatcggcaatccacaccccagatccatccctgtatcgtgagccaaccttcctgcaaagtcctcgtgggcatcggcatgtcctatttctctttccttggggcatcctcgtcattaatgaccccatccgcgacaatcctaccgctgctgtcctgccgtgcgtctctgacggtgagcttagtcagtcgtcttcgcagtagacacagctcccggatagctgctaccaagttcgacgcatctatatatcgctgcgcgtcagacgccggcgacacacgcatcttccgtagtcatgccgggagacgtcagccgagcagtacatatcgcgttgtaccgacaatcctaagtgcaatcgatgtggttgtcgcaagctccgtcacaagctgccgcgtcttcgtggctaacagcggcgcatgtgcgccctga

SEQ ID NO: 256 - protein, 313 aa, Homo sapiens
MEDYIHKLVYTVFACGRHPALLLLFVPVLPSAGSSPLPGHVLSIFSPPARIPHARSVSSQLFPYAAVASFGPSLRVVEFLERLLLVRAADRSCRSRFAPIRDRGLRSSRCRTDLRVSGWHGLPLDLPKEYTYACYINCTASAGIVTEMLRPFITLVSRAARWSQDPFSPSSSAAHRQSTPQIHPCIVSQPSCKVLVGIGMSYFSFLGASSSLMTPSATILPLLSCRASLTVSLVSRLRSRHSSRIAATKFDASIYRCASDAGDTRIFRSHAGRRQPSSTYRVVPTILSAIDVVVASSVTSCRVFVANSGACAP

SEQ ID NO: 257 - DNA, 291 bp, Homo sapiens
  CDS (1)...(291)
atgctttggctccttttggctctttttgccccgggtcgggcggggggcggggggtgggggtgcatcttccctgatacaccacactctccattccctgggatatatgacactgattgggctaccacgatcggggactccacaccactactatggcccttcatttctgtggctctgtgctcctccagtgcacttcctgcagggcacccggcattccccaatcctagacgctacgcagatgccagccatgcagaatcacataccatcttacctgctgagctctcccctttgtga

SEQ ID NO: 258 - protein, 96 aa, Homo sapiens
MLWLLLALFAPGRAGGGGWGCIFPDTPHSPFPGIYDTDWATTIGDSTPLLWPFISVALCSSSALPAGHPAFPNPRRYADASHAESHTILPAELSPL

SEQ ID NO: 259 - DNA, 231 bp, Homo sapiens
  CDS (1)...(231)
atgaaactcatggaaacacttaaccagtgcataaacgctggtcatgaaatgacgaaggctatcgccattgcacagtttaatgatgacagcccggaagcgaggaaaataacccggcgctggagaataggtgaagcagcggatttagttggggtttcttctcaggctatcagagatgccgagaaagcagggcgactaccgcacccggatatggaaattcgaggacggtgttga

SEQ ID NO: 260 - protein, 76 aa, Homo sapiens
MKLMETLNQCINAGHEMTKAIAIAQFNDDSPEARKITRRWRIGEAADLVGVSSQAIRDAEKAGRLPHPDMEIRGRC

SEQ ID NO: 261 - DNA, 375 bp, Homo sapiens
  CDS (1)...(375)
atgaagttcctgctcctggtcttggcagccctcggattcctgacccaggtgatcccaggtgcggattctgccgtaaaatgcgcccctggcgactcacgaccaggacgcattccgcaccgctcccccacgccccgcagcccgccctcgaggctgattgatttgtgccagtctctaccgccatctgccggcagcactcggtacacccgcgccctggaggtcgcacgcgctggccaaacgggcgcaccagacacttttcagggccctgccaaagacctcccaatgtctactggcgtcccagacacaagagatccaggccaagactcacacttcacaagatacacagacacgggccttagggaacaggaaattccatga

SEQ ID NO: 262 - protein, 124 aa, Homo sapiens
MKFLLLVLAALGFLTQVIPGADSAVKCAPGDSRPGRIPHRSPTPRSPPSRLIDLCQSLPPSAGSTRYTRALEVARAGQTGAPDTFQGPAKDLPMSTGVPDTRDPGQDSHFTRYTDTGLREQEIP

SEQ ID NO: 263 - DNA, 420 bp, Homo sapiens
  CDS (1)...(420)
atgaaagaggcattgaccaaccagacaccaatgactcaacaacttgatattagcctgattttactgatggccacttgggaactggtgcaaggagtgcagaggattcgagtatcacttattgttcttcctgatgacccactggaggacttgcgcttctattcttacacatttgtgtcctttggagttagagttcatggttctactcttgccatacgacacattaaaatacaagctatggctgctgctggccactttgaattccatcttggcagagaagtccgtgaaggtcacttagaagttattttccaaacatgcaatggaaagtgtatctctgtgactaaacaagtggactgtggtggccatagtagagcacgactcagattgtcctctgaaaaaacctgctgtagaaagcatatttga

SEQ ID NO: 264 - protein, 139 aa, Homo sapiens
MKEALTNQTPMTQQLDISLILLMATWELVQGVQRIRVSLIVLPDDPLEDLRFYSYTFVSFGVRVHGSTLAIRHIKIQAMAAAGHFEFHLGREVREGHLEVIFQTCNGKCISVTKQVDCGGHSRARLRLSSEKTCCRKHI

SEQ ID NO: 265 - DNA, 477 bp, Homo sapiens
  CDS (1)...(477)
atgttttattggttggtgcaacgggtagcctgtgttttactgttaactgcaatgctttttcaaacggatgcttttgaaacaccctggaatatagttggcagaatgaataaaggaatgaataaaagcattgttcacataatgcgatataactttctagaaggtcaaattaaccctactttcgatgtagaaatgactaacataaccgaagatctaatggtgatgtggtcatgcacacagtgtgtaggtgctaccaactgttgcagacacagttcatctcagaacagaaagcatgaaactctagccacaggaatcagaatccttcttccccaagggtcaatcactcattccccagctgctgaaagtgtggctgccaattgtttacagctgtatccttctctcaagcattactctcagtctctgggagccaagtcttctggaaatgtctgggaggctatactaggaaggagagggtggtag

SEQ ID NO: 266 - protein, 158 aa, Homo sapiens
MFYWLVQRVACVLLLTAMLFQTDAFETPWNIVGRMNKGMNKSIVHIMRYNFLEGQINPTFDVEMTNITEDLMVMWSCTQCVGATNCCRHSSSQNRKHETLATGIRILLPQGSITHSPAAESVAANCLQLYPSLKHYSQSLGAKSSGNVWEAILGRRGW

SEQ ID NO: 267 - DNA, 603 bp, Homo sapiens
  CDS (1)...(603)
atggctgcagcttggaccgtggtgctggtgactttggtgctaggcttggccgtggcaggccctgtccccacttccaagcccaccacaactgggaagggctgccacattggcaggttcaaatctctgtcaccacaggagctagcgagcttcaagaaggccagggacgccttggaagagtcactcaagctgaaaaactggagttgcagctctcctgtcttccccgggaattgggacctgaggcttctccaggtgagggagcgccctgtggccttggaggctgagctggccctgacgctgaaggtcctggaggccgctgctggcccagccctggaggacgtcctagaccagccccttcacaccctgcaccacatcctctcccagctccaggcctgtatccagcctcagcccacagcagggcccaggccccggggccgcctccaccactggctgcaccggctccaggaggcccccaaaaaggagtccgctggctgcctggaggcatctgtcaccttcaacctcttccgcctcctcacgcgagacctcaaatatgtggccgatggggacctgtgtctgagaacgtcaacccaccctgagtccacctga

SEQ ID NO: 268 - protein, 200 aa, Homo sapiens
MAAAWTVVLVTLVLGLAVAGPVPTSKPTTTGKGCHIGRFKSLSPQELASFKKARDALEESLKLKNWSCSSPVFPGNWDLRLLQVRERPVALEAELALTLKVLEAAAGPALEDVLDQPLHTLHHILSQLQACIQPQPTAGPRPRGRLHHWLHRLQEAPKKESAGCLEASVTFNLFRLLTRDLKYVADGDLCLRTSTHPEST

SEQ ID NO: 269 - DNA, 624 bp, Homo sapiens
  CDS (1)...(624)
atgggaagaatcccggtaattctgctgctggctgccccccctgtctccctgtcagcggtgcgactagctactagtagtaggaggactaagccactaacgagcttcctcgctctgcagaaacgtttgggcctcgtcccatcggcggactatatgcagtatctccctattgtacgtcggggcaggcagcatagcattgtggcgtccacccagacgggccgggcttcggtagtgactgctacttactctggcgcgcgcgatatctcaggcatcagttttcgaaccagggctcatagagccctcggatatttacttcacagagtttttatgaggatagcttttgatagaagctgcaggagcctgcgcgtcatccgagatgcccacgggggtcttccttaccttcaggtggaatgccaccccagggacaaccctcctgtggagtacttgttcctacaccttggttggcgagagcaaaccgatgcaggcgtttctaaaacaaatgagccctgggagagccctgaacgcatttattatgagcctcgagggactgggaagctgcagagacccaaagctgtccgagaggacttgggacttgctctgcaaaagacctggcctctgcttttttga

SEQ ID NO: 270 - protein, 207 aa, Homo sapiens [sequence omitted]

SEQ ID NO: 271 - DNA, 888 bp, Homo sapiens
  CDS (1)...(888)
atggccggactgctcagtccaatactgctcatgctgctcgcactagttaatgtcaggacccagacacctcgtactaacaccttgattgactgcgcccctggatgggcgctaaaagatcgcagtgtaggttcgggatccacgtcgatgttggcagcgcagcatatcgcctaccccgggtaccaggtgcttattctagaacgtctaatgcccctcaccacggacagccgtctgttttggagcacggacaagtggatcgtccgcggcgaaccttatttaagaatgaggagttttgcatatcgcatcacctgtccgaaactcaaatcgtatgaacaacagctgtacgaagcgttacaacgtctcgtaactgaaagtaaccaacacctgaaggtacgacatgtacgatcgaaatggcatctatatgtatccacgcgcttgtcacgacggcatcgcacggcacaggacgtatgcattggagacgctgcattgaccggatatggtctagacgcacggacgcgtacgaagacgcatatgtactgtgtcgacacgtactctgatctgaaggcaatggtatcgactctggtacgaattgtgtctgacagtcgcgtcgacccgtatcggattgtctatcgactgcggatccgtattcgcatgcgatcggctctcacgcgactcatactgctatggctcgtgactgtgatggatgcgcttctaattcgcggcgtctcgctctcgaacgactatctcatcttattctcaatcgatacgcgcacgcgtgcgagactccgcatggatcgtctatctgctagtgtatctatgctgactgatactgccatggtactagtcactgacatcgtgatgcgtgctgtactcgtcactctgcatgcgtga

SEQ ID NO: 272 - protein, 295 aa, Homo sapiens
MAGLLSPILLMLLALVNVRTQTPRTNTLIDCAPGWALKDRSVGSGSTSMLAAQHIAYPGYQVLILERLMPLTTDSRLFWSTDKWIVRGEPYLRMRSFAYRITCPKLKSYEQQLYEALQRLVTESNQHLKVRHVRSKWHLYVSTRLSRRHRTAQDVCIGDAALTGYGLDARTRTKTHMYCVDTYSDLKAMVSTLVRIVSDSRVDPYRIVYRLRIRIRMRSALTRLILLWLVTVMDALLIRGVSLSNDYLILFSIDTRTRARLRMDRLSASVSMLTDTAMVLVTDIVMRAVLVTLHA

SEQ ID NO: 273 - DNA, 579 bp, Homo sapiens
  CDS (1)...(579)
atgcttctgattgagctgggcttggctgatcgagtctgggctcgctcatgtgtctgtgggctgccggcagctcagcaaggggctggctggactagcgaagccatgaagccacgaagccacgggcttgtcacaggctttcaggggacacagcaaacagtaaaagctctgcagattcaacgaaggccagctgggtttgaaccagccatgcaggggaacctccagggttcccttcgaattggacattgccattgtcccctgggtgcagatgagggcagtgacctgcctgaggtcacagtgctggtgagggatggcagcaggactccacacccgggggtctacccaggctggtaccatcggccagtacgagggcttgtcaacatgaaggttccatttgtcaggcccctgcatgaggaccccaaccccctgaagatcttcatgttaagtgctgctggcaacaaaagtagatggatccctggaagtctctgtctgcacgtgacagctactccaaccactgctgagcttccaggagcttcccgtgatggcaaggtaccagctgtgtgccgagtaccagctgtgtga

SEQ ID NO: 274 - protein, 192 aa, Homo sapiens
MLLIELGLADRVWARSCVCGLPAAQQGAGWTSEAMKPRSHGLVTGFQGTQQTVKALQIQRRPAGFEPAMQGNLQGSLRIGHCHCPLGADEGSDLPEVTVLVRDGSRTPHPGVYPGWYHRPVRGLVNMKVPFVRPLHEDPNPLKIFMLSAAGNKSRWIPGSLCLHVTATPTTAELPGASRDGKVPAVCRVPAV

SEQ ID NO: 275 - DNA, 510 bp, Homo sapiens
  CDS (1)...(510)
atgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctaggacacagagaggctttgttgtctttgtggtcaccgggtccactttacacagatgcctattaatcacttcactatggagacagacacatccatcatatcacagcagctcagaaacgggccgtccagtgaaagggggtgagaggggaaagtgcacacttaaccatttcgagttaggttactggttgcctgtgtcttacacgcttagggtggtaattggggtggggactctggagtatgcttattcttcatccaagaaaaagcagagttggcactactgtgagaaaagtacttaa

SEQ ID NO: 276 - protein, 169 aa, Homo sapiens
MRSEALLLYFTLLHFAGAGFPEDSEPISISHGNYTKQYPVFVGHKPGRNTTQRHRLDIQMIMIMNGTLYIAARTQRGFVVFVVTGSTLHRCLLITSLWRQTHPSYHSSSETGRPVKGGERGKCTLNHFELGYWLPVSYTLRVVIGVGTLEYAYSSSKKKQSWHYCEKST

SEQ ID NO: 277 - DNA, 423 bp, Homo sapiens; identical to SEQ ID NO: 161
  CDS (1)...(423)

SEQ ID NO: 278 - protein, 140 aa, Homo sapiens; identical to SEQ ID NO: 162

SEQ ID NO: 279 - DNA, 333 bp, Homo sapiens
  CDS (1)...(333)
atgatgctgctgttgctgtgtctggggttgaccctcgtctgtgcccaggaggaagaaaacaatgatgctgtgacaagcaacttcgatctgtcaaagcacattgctcaggatatagcatcaattcgaacaccggatgtgagctcacaactcaaggagaggtttgtgaaatattgtgaagaacatgggattgataaggaaaacatatttgacttgaccaaagttggattctctgctgaaatcatgcgggccgattcgcggtctcgatgtttaaccgtgctggtaacaccaaacctcgatgcttgcgacgacttggtgcacatattgttcgactag

SEQ ID NO: 280 - protein, 110 aa, Homo sapiens [sequence omitted]

SEQ ID NO: 281 - DNA, 471 bp, Homo sapiens
  CDS (1)...(471)
atgaaaataagctgctcagatcttctgctgcagggagcaaagttgatgatggttccagctgactcccttctggatttactgctgttaacctgccttcctcaggcaggagagtctcgagtagaaggcaaagatacccctgcctcgcctgaacataaagcggatgcgcacatcgttaagatccacgtgatagagataaatcctcgatttaatctaggcgggagtgatgcgtttcttgtgagcccgattcggcaagatttacgtgggcaggtcctttctatattcgagctgacccaaagcaccttatcagatgaaaggattactcagcatcaacatttacatagtagaggtgagctatcttgtgaaccggatgtggagcccttaggcttcagcgcccggaaaggtcaatgcctccgtagggaccacagtcagattgcaactcctccttcggtaaatgccgaaaaaacaacgtag

SEQ ID NO: 282 - protein, 156 aa, Homo sapiens
MKISCSDLLLQGAKLMMVPADSLLDLLLLTCLPQAGESRVEGKDTPASPEHKADAHIVKIHVIEINPRFNLGGSDAFLVSPIRQDLRGQVLSIFELTQSTLSDERITQHQHLHSRGELSCEPDVEPLGFSARKGQCLRRDHSQIATPPSVNAEKTT

SEQ ID NO: 283 - DNA, 702 bp, Homo sapiens
  CDS (1)...(702)
atggaaggctccatttatgcttggggcattctcttgatgttgggcgcggttcctccggggtggtgtgggggtgtgttgaaatctgctcgacgtccggagaaggctacggccgttgtgctacatgaggagtgtatgcgtaaacatcttgcggctaaaccgaccgctctaattttaaaaaggcatcggcaagcaggcgcccacaagtcgagttacccgggtcaacaaagctcagcgcctaccttcgagagaggacggcttcgcatcggtgcaccagcaactccacaatacatgaaagtaagccggttcaccagaccccagcccagtctccaagttgcacagcatgtaaattcagccaccaagttcccctgcagggcttttgggacctatcttcaggtggtcgacaaggcttggaactctcgctggcagactagtattgtcataatacctggacccacgggcatgaacgcctcaccatcacatccgagtcagctttgcgcggcgtctgaatcggtccggcatcggttacgcattgggcgcctgcccgccgccaagggtttagcttcgctcatgtcaagacgtcttcgtccgatgactggaactacagctgaagtgtcgtcaaaaatcatcagggatgggggagcagaacgtcccgggggaccgcggctcccaactcacgttgctcccactccgagactcaagtaa

SEQ ID NO: 284 - protein, 233 aa, Homo sapiens
MEGSIYAWGILLMLGAVPPGWCGGVLKSARRPEKATAVVLHEECMRKHLAAKPTALILKRHRQAGAHKSSYPGQQSSAPTFERGRLRIGAPATPQYMKVSRFTRPQPSLQVAQHVNSATKFPCRAFGTYLQVVDKAWNSRWQTSIVIIPGPTGMNASPSHPSQLCAASESVRHRLRIGRLPAAKGLASLMSRRLRPMTGTTAEVSSKIIRDGGAERPGGPRLPTHVAPTPRLK

SEQ ID NO: 285 - DNA, 369 bp, Homo sapiens
  CDS (1)...(369)
atgccctgtgccctttgggaacataagaacaaagtacgcctgtctcccctctcatcgttgttactgttgcttcatccaggatatggtggacagtcagaatccgaaagcttgcagcaaaatggctggctttaccttattttggagggaatatattttctgaaagttcaggcctgggtaattccaaatgacaatctgaatagaatgttattggcagaagtgaacaaatatgaaaatgttctcgtaattaaggtcctaggagagttacatgggacacccaagagtgcttatgagaaagtttggggcattgctgatagcaatcagaatcagaaatgtacctgctcagattatccatataaacaattgaaataa

SEQ ID NO: 286 - protein, 122 aa, Homo sapiens
MPCALWEHKNKVRLSPLSSLLLLLHPGYGGQSESESLQQNGWLYLILEGIYFLKVQAWVIPNDNLNRMLLAEVNKYENVLVIKVLGELHGTPKSAYEKVWGIADSNQNQKCTCSDYPYKQLK

SEQ ID NO: 287 - DNA, 486 bp, Homo sapiens
  CDS (1)...(486)
atggggaaactcttgactttggtcagcatgctcctaagtggactgcaggctatgtgggaactggtgtatagaactattgggcaccaacttcactggatcagtggctatatagcgacggttgtacgagggtttcgccacgtcacacaaggtgattgcaaacattatgtgatcctcacaaacacaggttgtatctgtggtggacaagttatgtggactgtaccttattgttatcctggtgtgtcatcagttggttgcattaactgtcttcccattttgtctccattgaggttaagtaacctatgtgttttattcaacgcaatgagagggagacgtaacaaggtgtttgtttcacccgaggacctaacacggctcgggggagagaagggaggtaccagaagagcggaagagggaagagagacagaaaaggagcatatagaagatcggaagaggaaaaggagaaaggaaatagtcaacaaggaaaaatag

SEQ ID NO: 288 - protein, 161 aa, Homo sapiens
MGKLLTLVSMLLSGLQAMWELVYRTIGHQLHWISGYIATVVRGFRHVTQGDCKHYVILTNTGCICGGQVMWTVPYCYPGVSSVGCINCLPILSPLRLSNLCVLFNAMRGRRNKVFVSPEDLTRLGGEKGGTRRAEEGRETEKEHIEDRKRKRRKEIVNKEK

SEQ ID NO: 289 - DNA, 651 bp, Homo sapiens
  CDS (1)...(651)
atgaggggcacccacatcctcatggggctgagtctcttctatcccatcagagccctggaaacagggacccaagtggtctgcggccaccagccctggtgtggcctgaaggctgggcgtctaggcctccggcctccaccccctctgtgcagtgggcagtcacacctggcggggcccggctgcctgcccagacagcaggttctcagcagcagccctggcgtcccaggagaggggcttctctctgctcccggcttccaggagcacagggatgcctgggtctgcagccatgacttgggcagctgcatctgtgcccagaggggtggggctcctgcctgctccatggagcagaaggcctggatctgcagctgggacttgggtggggcttctgcctgctctgtggagcaggaggtctgggtctacagctgtgacttcagtggctgcagctgtgcccaggagagtggggcacccatctgctcccggcccgagagcacagggatgcctaagtctgcagagagctaccacccacctcggaaggggcaggggctctgcttgtccgcagctcctgccagttccatggagcatgcagccctggctgtggctgcctgctgcagctggcatgatggcaccagccactttagatggacccgggtgtaa

SEQ ID NO: 290 - protein, 216 aa, Homo sapiens [sequence omitted]

SEQ ID NO: 291 - DNA, 708 bp, Homo sapiens
  CDS (1)...(708)
atgcggcctgatgacattaacccgaggactgggctggtggtggccctggtcagtgtcttcctcgtctttggtttcatgttcaccgtctctgggatgaaaggggagactttgggaaacatccccctcctggccatcgggccagccatctgcctaccaggcatcgcagccattgccctggccaggaaaaccgagggatgcaccaagtggccagagaacgagctgctgtgggtccgcaaattgccctgcttccggaaacccaaagacaaggaggtggtagagctgctgaggaccccttcagacctagaatccggcaaggggagctcagatgagctggctaagaaggcgggcctcagggggaagcctcccccacaaagccagggtgaggtgtccgtggccagctccatcaacagccccacacccacggaggaaggagaatgccagagcctcgtccagaatgggcatcaggaggagacgtccagatacctggacggctactgcccctcgggcagttccctcacctacagtgccttggacgtcaagtgctcagcaagggacagatctgagtgccctgagcctgaggatagcatcttctttgtgccccaggacagtatcatcgtttgctcctacaagcagaacagcccgtatgacagatactgttgttatatcaatcagatacaaggcaggtgggaccacgagaccatcgtctaa

SEQ ID NO: 292 - protein, 235 aa, Homo sapiens
MRPDDINPRTGLVVALVSVFLVFGFMFTVSGMKGETLGNIPLLAIGPAICLPGIAAIALARKTEGCTKWPENELLWVRKLPCFRKPKDKEVVELLRTPSDLESGKGSSDELAKKAGLRGKPPPQSQGEVSVASSINSPTPTEEGECQSLVQNGHQEETSRYLDGYCPSGSSLTYSALDVKCSARDRSECPEPEDSIFFVPQDSIIVCSYKQNSPYDRYCCYINQIQGRWDHETIV

SEQ ID NO: 293 - DNA, 822 bp, Homo sapiens
  CDS (1)...(822)
atggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttcttcctcaacttcgaaaaggggaaactacacaaaaaagagaccgtgagaacagcgtccggtgcccggcggtcccctgtgagagcagaagcctgtgtcggagccgctggagcccattcttcctgttcatcctgatcatcttcctggcagagctctcagcagccatcctggccttcatcttcagggaaaatgtacgtatcaggccccaagctttcctgcctcctgctatcagcaaggggttggtggccattcagctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgagcttttcgccatgatctttgccatgtgcctcttccggggcatccagtag

SEQ ID NO: 294 - protein, 273 aa, Homo sapiens
MVDPTGFREIVAANPLLLTGAYILLAMGGLLFLLGFLGCCGAVRENKCLLLFLPQLRKGETTQKRDRENSVRCPAVPCESRSLCRSRWSPFFLFILIIFLAELSAAILAFIFRENVRIRPQAFLPPAISKGLVAIQLTREFFTKELTKHYQGNNDTDVFSATWNSVMITFGCCGVNGPEDFKFASVFRLLTLDSEEVPEACCRREPQSRDGVLLSREECLLGRSLFLNKQGCYTVILNTFETYVYLAGALAIGVLAIELFAMIFAMCLFRGIQ

SEQ ID NO: 295 - DNA, 567 bp, Homo sapiens
  CDS (1)...(567)
atgagcagagaccacaggctgctgtgcctcctgggcctctgttgtgtggcagatgcttccaaacagcccttcaggaaatctggaattcccagaggttatacattgcacctgaggccatctggctacaatccaaactctgggtgcggctggcgccaaagctactacaccatgctgccttctaagctgcatttcatctggaaccgctgtggctggcaggccgagcctctgaacactgcaattcaggttaatcatgcagacctgctggagcacgcggggccgaggggaggcccacactaccgctttccccactctggggacggggagaacctgatttgtcttcggtccacagctagtgtgtgcaagggcccaattcaggtccagatcggcgtgctgacaaggactgtgtttggggctgctcccctgcagacagagccccatgggcaggccctgatgggcggtcagaggacacaagacaagagccagggtgctaagcagacgcccctatgggacatgggccagccgatgtttggatgcttccaaacaccaacaacagttttggacgagtaa

SEQ ID NO: 296 - protein, 188 aa, Homo sapiens [sequence omitted]

SEQ ID NO: 297 - DNA, 852 bp, Homo sapiens; identical to SEQ ID NO: 151
  CDS (1)...(852)

SEQ ID NO: 298 - protein, 283 aa, Homo sapiens; identical to SEQ ID NO: 152

SEQ ID NO: 299 - DNA, 369 bp, Homo sapiens
  CDS (1)...(369)
atggccctgggcaaggttctggccatggcactggttttggccttggccgtgctggggtcgctgtcccctggggcccgggcgggggactgcaaggggcagcggcaggtgctgcgggaggcgccaggcttcgtgacggatggtgcgggcaactacagcgtcaatggcaactgcgagtggctcatcgaggaaccctgccccagtggctctttctctgtgaagacatgtggcttaacctggggtatagctgagatcagaggcatctgtacgagggagcagaagggcattccaggcaagaatagctgtgcaaaggcggggaagcgggagagtgatgcttttgaagaactagaaatccagtgtgttaaaacatag

SEQ ID NO: 300 - protein, 122 aa, Homo sapiens
MALGKVLAMALVLALAVLGSLSPGARAGDCKGQRQVLREAPGFVTDGAGNYSVNGNCEWLIEEPCPSGSFSVKTCGLTWGIAEIRGICTREQKGIPGKNSCAKAGKRESDAFEELEIQCVKT

SEQ ID NO: 301 - DNA, 411 bp, Homo sapiens
  CDS (1)...(411)
atggacgcatacagcgcgtctttaagcggtcccaacagcctcgggctgtccactttagtacccccaagcaatgcgcgagagtgcccgacggaaccaccaaagatactgtctctgtcagttccaccaagccctgcagtagaacctagacccagatggaaagagaacaagacaaaatcaggaagtagaggcagctctagtgctgacaactgccagggaagcaatgagctgaatgggttccctgaagccgccataacaaagaccacaaagttagtttcacaacaaatgtatattgagtgcctgctccacaccaggcactgttgtaggccccgggagtacagctgtgaacaaaacagtgaagatacttcatcagagacagtttgcggagatgaaaatgctcctcaagagctttga

SEQ ID NO: 302 - protein, 136 aa, Homo sapiens [sequence omitted]

SEQ ID NO: 303 - DNA, 915 bp, Homo sapiens
  CDS (1)...(915)
atgctgccgccgccgcggcccgcagctgccttggcgctgcctgtgctcctgctactgctggtggtgctgacgccgcccccgaccggcgcaaggccatccccaggcccagattacctgcggcgcggctggatgcggctgctagcggagggcgagggctgcgctccctgccggccagaagagtgcgccgcgccgcggggctgcctggcgggcagggtgcgcgacgcgtgcggctgctgctgggaatgcgccaacctcgagggccagctctgcgacctggaccccagtgctcacttctacgggcactgcggcgagcagcttgagtgccggctggacacaggcggcgacctgagccgcggagaggtgccggaacctctgtgtgcctgtcgttcgcagagtccgctctgcgggtccgacggtcacacctactcccagatctgccgcctgcaggaggcggcccgcgctcggcccgatgccaacctcactgtggcacacccggggccctgcgaatcggggccccagatcgtgtcacatccatatgacacttggaatgtgacagggcaggatgtgatctttggctgtgaagtgtttgcctaccccatggcctccatcgagtggaggaaggatggcttggacatccagctgccaggggatgacccccacatctctgtgcagtttaggggtggaccccagaggtttgaggtgactggctggctgcagatccaggctgtgcgtcccagtgatgagggcacttaccgctgccttggccgcaatgccctgggtcaagtggaggcccctgctagcttgacagtgctcacacctgaccagctgaactctacaggcatcccccagctgcgatcactaaacctggttcctgaggaggaggctgagagtgaagagaatgacgattactactag

SEQ ID NO: 304 - protein, 304 aa, Homo sapiens
MLPPPRPAAALALPVLLLLLVVLTPPPTGARPSPGPDYLRRGWMRLLAEGEGCAPCRPEECAAPRGCLAGRVRDACGCCWECANLEGQLCDLDPSAHFYGHCGEQLECRLDTGGDLSRGEVPEPLCACRSQSPLCGSDGHTYSQICRLQEAARARPDANLTVAHPGPCESGPQIVSHPYDTWNVTGQDVIFGCEVFAYPMASIEWRKDGLDIQLPGDDPHISVQFRGGPQRFEVTGWLQIQAVRPSDEGTYRCLGRNALGQVEAPASLTVLTPDQLNSTGIPQLRSLNLVPEEEAESEENDDYY

SEQ ID NO: 305 - DNA, 645 bp, Homo sapiens
  CDS (1)...(645)
atgctgaatgtctccggcctctttgttctcctctgtgggctgcttgtctcatcctctgcacaggaggtcctggctggagtttcttcccagctccttaatgatttgactcaaggactcctcagggcagactttcttcccagcctgcagacaactggcctccagaaaccattgagtagtgccttcgatggtgtatcaggcctcctggacatctttggacctccactcaccaatgagatcaacactgttagcatacaggtgaaaaatcctcaactcctccatgtctccatcgagagcacccctcaaagaaaggaggccactgtacaagtaccattcacgtctgagttgattgtgcagctcctgaccatgaagcccttcacagctaatatgcagtcagatataaaagtccagattcgtttggagaagaatgtaggtggcagatatgagcttgcctttgggaactgcaggctcttgcccgaggctatttggatccaaactggagtccatgagaaaacacaaggtgcaataagcattagacgagccataccgcggatcgtacaacccaccgtatcccatcaacagcgcctagggggccgagctcgacagcattctgcgcagcgtaaattcgacgccgactcccccgtttga

SEQ ID NO: 306 - protein, 214 aa, Homo sapiens
MLNVSGLFVLLCGLLVSSSAQEVLAGVSSQLLNDLTQGLLRADFLPSLQTTGLQKPLSSAFDGVSGLLDIFGPPLTNEINTVSIQVKNPQLLHVSIESTPQRKEATVQVPFTSELIVQLLTMKPFTANMQSDIKVQIRLEKNVGGRYELAFGNCRLLPEAIWIQTGVHEKTQGAISIRRAIPRIVQPTVSHQQRLGGRARQHSAQRKFDADSPV

SEQ ID NO: 307 - DNA, 480 bp, Homo sapiens
  CDS (1)...(480)
atgagccaagtgttagcgagccttgctctgagcagtcgtacggcacaggcgcgaacattgaacctgacgaagagcagatttaaaggactcgccgtcccttggatggagaaaaccactgttgcacaggtaagaacggcatatagctggcacgtgcactaccacagcctctgcctcgagtggccatggcagacactgccattcaatcctggtctgaacacaacccccttcccaacacagctgtctacatcctacccgtcagagcaggcacaccatgtgaaacttctctgccattccttgcctagtggctctgtacacagtgttcctaagctcctctattgggctcccacgggactctatattcgagaccacattccacctgccctaatcaccccggggcctagtacccggcaactaggaacagccccagcacccctgaacccactacaattattcaaactagccagtgctaaacctgcttaa

SEQ ID NO: 308 - protein, 159 aa, Homo sapiens [sequence omitted]

SEQ ID NO: 309 - DNA, 907 bp, Homo sapiens
  CDS (1)...(907)
atgctgttcctcgtcctcctgctgcccctggagctgagcctggcaggcgcccttgcacctgggacccctgcccggaacctccctgagaatcacattgacctcccaggcccagcgctgtggacgcctcaggccagccaccaccgccggcggggcccgggcaagaaggagtggggcccaggcctgcccagccaggcccaggatggggctgtggtcaccgccaccaggcaggcctccaggctgccagaggctgaggggctgctgcctgagcagagtcctgcaggcctgctgcaggacaaggacctgctcctgggactggcattgccctaccccgagaaggagaaccgacctccaggttgggagaggaccaggaaacgcagcagggagcacaagagacgcagggacaggttgaggctgcaccaaggccgagccttggtccgaggtcccagctccctgatgaagaaggcagagctctccgaagcccaggtgctggatgcagccatggaggaatcctccaccagcctggcgcccaccatgttctttctcaccacctttgaggcagcacctgccacagaagagtccctgatcctgcccgtcacctccctgcggccccagcaggcacagcccaggtctgacggggaggtgatgcccacgctggacatggccttgttcgactggaccgattatgaagacttaaaacctgatggttggccctctgcaaagaagaaagagaaacaccgcggtaaactctccagtgatggtaacgaaacatcaccagccgaaggggaaccatgcgaccatcaccaagactgcctgccagggacttgctgcgacctgcgggagcatctctgcacaccccacaaccgaggcctcaacaacaaatgcttcgatgactgcatgtgtgtggaag

SEQ ID NO: 310 - protein, 302 aa, Homo sapiens
MLFLVLLLPLELSLAGALAPGTPARNLPENHIDLPGPALWTPQASHHRRRGPGKKEWGPGLPSQAQDGAVVTATRQASRLPEAEGLLPEQSPAGLLQDKDLLLGLALPYPEKENRPPGWERTRKRSREHKRRRDRLRLHQGRALVRGPSSLMKKAELSEAQVLDAAMEESSTSLAPTMFFLTTFEAAPATEESLILPVTSLRPQQAQPRSDGEVMPTLDMALFDWTDYEDLKPDGWPSAKKKEKHRGKLSSDGNETSPAEGEPCDHHQDCLPGTCCDLREHLCTPHNRGLNNKCFDDCMCVE

SEQ ID NO: 311 - DNA, 670 bp, Homo sapiens
  CDS (1)...(670)
atgggaatggtttacagtagtgcccttttatccctggttttggttgccatggttttagttacccacagtcaaccatggtctgaaaacaggggccaagctgctgcatccttatgttctcagccagagaaacagcctagcaaacgcatccaatgtggcctttcctctgaattggataccctgccacacgtctgcatgtctgtacccctgctgataggagtttcaggaatcggagctatctatcagttgaactcttcaccgatgacaacagtaatgacaagagcacctggaagtcctgttctccaagcactggacttcattttttatgtgaacaaaatgaaaatgaatgtggaagaaatgtggaaagggatgagcggtacgtcattcttcgctcttccaagaaaaaaagatattcttccacgatggttgaggggcaaacagttggtaaaattccagaataccaagtcacaaagcagagaatcgtgttccctcccaaatttacatgttgaagtcataaaccctgtaattcttaatgtgactgtatttggaaacagggcctttaaagaagtaattaagtattacattcagtgtaggcattcaataagttcaggcttagtgaaggttgtcactgaaatcccatcagctcagcagggagcaaggagcctctttgaaa

SEQ ID NO: 312 - protein, 223 aa, Homo sapiens [sequence omitted]

SEQ ID NO: 313 - DNA, 426 bp, Homo sapiens
  CDS (1)...(426)
atggaaggggaccccggggggttgctgctgctgctgctggctggggtggggggatatcagctgggaactagaaggaacttctcccatggagaaaaggtaaacgataagatcccagtagccaccatcagcatctgggacaaatacagccctcaccactggggtcccctgcagtcctcacaggcactaagcccacctgagggagctaactggagcccacacagctgtgctgtctccacaaaaggagctgatactgtgcactgccctcggtggtccacgcagctactatactgcaccatcctagaactaggactaccactagagtgtgccttactacaaggcgtcagactccaggatcttggacttttggaatcttggatttacaccagtggtctacctgaggctcttgggcctccggccatagagtga

SEQ ID NO: 314 - protein, 141 aa, Homo sapiens [sequence omitted]

SEQ ID NO: 315 - DNA, 375 bp, Homo sapiens
  CDS (1)...(375)
atggtcctgtgctggctgctgcttctggtgatggctctgcccccaggcacgacgggcgtcaaggactgcgtcttctgtgagctcaccgactccatgcagtgtcctggtacctacatgcactgtggcgatgacgaggactgcttcacaggccacggggtcgccccgggcactggtccggtcatcaacaaaggctgcctgcgagccaccagctgcggccttgaggaacccgtcagctacaggggcgtcacctacagcctcaccaccaactgctgcaccggccgcctgtgtaacagagccccgagcagccagacagtgggggccaccaccagcctggcactggggctgggtatgctgcttcctccacgtttgctgtga

SEQ ID NO: 316 - protein, 124 aa, Homo sapiens
MVLCWLLLLVMALPPGTTGVKDCVFCELTDSMQCPGTYMHCGDDEDCFTGHGVAPGTGPVINKGCLRATSCGLEEPVSYRGVTYSLTTNCCTGRLCNRAPSSQTVGATTSLALGLGMLLPPRLL

SEQ ID NO: 317 - DNA, 688 bp, Homo sapiens
  CDS (1)...(688)
atggagcccctgcgcgcgcccgcgctgcgccgcctgctgccgccgctgctgctcctgctgctgtcactgcccccccgcgcccgggccaagtacgtgcggggcaacctcagttccaaggaggactgggtgttcctgacaagattttgtttcctctcggattacggccgactggacttccgtttccgctaccctgaggccaagtgctgtcagaacatcctcctctattttgatgacccatcccagtggccagccgtgtacaaggcaggggacaaggactgcctggccaaggagtcagtgatccggccggagaacaaccaggtcatcaacctcaccacccagtatgcctggtccggctgtcaggtggtatcagaggagggaacccgctacctgagctgctccagtggccgcagcttccgctcagtgcgtgaacggtggtggtatattgcgctcagcaagtgtgggggtgatggattgcagctggagtatgagatggtcctcaccaatggcaagtccttctggacacgacacttctccgctgatgagtttgggatcctggagacagatgtgaccttcctcctcatcttcatcctcatcttcttcctctcttgttactttggatatttgctgaaaggtcgtcagttgctccacacaacttataaaatgttcatggccgcagcaggagtagagg

SEQ ID NO: 318 - protein, 229 aa, Homo sapiens
MEPLRAPALRRLLPPLLLLLLSLPPRARAKYVRGNLSSKEDWVFLTRFCFLSDYGRLDFRFRYPEAKCCQNILLYFDDPSQWPAVYKAGDKDCLAKESVIRPENNQVINLTTQYAWSGCQVVSEEGTRYLSCSSGRSFRSVRERWWYIALSKCGGDGLQLEYEMVLTNGKSFWTRHFSADEFGILETDVTFLLIFILIFFLSCYFGYLLKGRQLLHTTYKMFMAAAGVE

SEQ ID NO: 319 - DNA, 765 bp, Homo sapiens
  CDS (1)...(765)
atgggagctccaaagctggccaagctgcacacagccctgctggcgtccagcctggctctaggccaggagccttggctggagggcggcccagcgccccgacagccacgtccagcaccttcagcaggttctccccggcagcacttggcagtcagatgtggccagacggtcccttccagagagagctgtcgtggccccaaaggcatgaacgtggccctccgtgcacggcaagcagtacaggaacgtgttcggaaggcagagtgcgcggccaacagctgtgctgccctggacaagtgccctccacctcaacagtttcccctgcaaggcctccatgatgagcggaacacagccactcctggggaagggcacaagcagcagtcacacgtcgcactgaagtggctggatggacgccagagagtccagaggcagacaggaaacacaaaatggaagatgctggtgcacgcagaaagtcttggaggaggagagccagaaaccttcacaaaatccaaatcagacctcgtctctgctcacttcaccccgtcgcagcttcttacgctcccccccatttttacagacaaggaaactgagtcccagaggcccggaaatggggagggcggggagtcaggacaggtggcaggaacagggctgcctctagggcaactgatgaaccctggcagcagcatccgtgacactggagagcccaacaccagctgccactgtgtggccctgtggcattggccacaaatgagcacatccatcagctcctga

SEQ ID NO: 320 - protein, 254 aa, Homo sapiens
MGAPKLAKLHTALLASSLALGQEPWLEGGPAPRQPRPAPSAGSPRQHLAVRCGQTVPSRESCRGPKGMNVALRARQAVQERVRKAECAANSCAALDKCPPPQQFPLQGLHDERNTATPGEGHKQQSHVALKWLDGRQRVQRQTGNTKWKMLVHAESLGGGEPETFTKSKSDLVSAHFTPSQLLTLPPIFTDKETESQRPGNGEGGESGQVAGTGLPLGQLMNPGSSIRDTGEPNTSCHCVALWHWPQMSTSISS

SEQ ID NO: 321 - DNA, 339 bp, Homo sapiens
  CDS (1)...(339)
atggtgctcaccaatacggcttctttctatgcagctctgcagctactgctggctcttctgggaattttttcttttgtatatccgtccctggtggatcacttgccctttcctgccaaacccttgcctctgtctgaattctggtttggctcttcctttgtggcccccagagcctctgccaatcttgttggagcatttgcagcaataggaaaaaggtcccccttcttcagggcacccatgatcttgaaacagagactcatgaagactcatgaatgggtttcaactcccatccatcctctctgccaagcccttgtggagaccacagtccatgaccctgaataa

SEQ ID NO: 322 - protein, 112 aa, Homo sapiens [sequence omitted]

SEQ ID NO: 323 - DNA, 888 bp, Homo sapiens
  CDS (1)...(888)
atgcgcctccacctgctcctgctgctcgcgctgtgcggtgcaggcaccaccgccgcggagctcagttacagcttgcgtggcaactggagcatctgcaatgggaacggctcgctggagctgcccggggcggtccctggctgcgtgcacagcgccttgttccagcagggcctgatccaggtcactctgttgtgtgaaggctacagtgcaggagagtggaagcctggagaccaaccaggggactattgctggtctatgtatgggcaagagatgacttctggcttggacaagcatggtggcagtgaaatgctccaaacacatttctacaccgataacaagaaatatgctgtaaatgatgtttccttctcaatccctgccgcctctgaatttgctgaccttagtaacatcatcaataaattactaaaggacaaaaatgagttccacaaacatatggagttttatttccttattaagggccagtttctgcgaatgtccttggtcaaacacatggaactggagaacatgtcatcagaagtagttgtggaaatagaatatgtgaagtacacagcaccccagccagagcaatgcatgttccatgatgactggatcctttcagttaaaggggcaaaggaatggatcttgactggttcttatgataagacctctcaaatccggtccttggaaagaaagtcaataatgacaattgttggacatagggatgtcttaaaagatgtggcctgggccaaaaaaaaagatagtttgtcttgcttatttgtgagtgcctctatggatccaactattctcttatgggagtggaatagagagaaacaaagtgaaagcccgaccgtgctgcagaggtcatgctggaagtgcagagtctatagctgttga

SEQ ID NO: 324 - protein, 295 aa, Homo sapiens
MRLHLLLLLALCGAGTTAAELSYSLRGNWSICNGNGSLELPGAVPGCVHSALFQQGLIQVTLLCEGYSAGEWKPGDQPGDYCWSMYGQEMTSGLDKHGGSEMLQTHFYTDNKKYAVNDVSFSIPAASEFADLSNIINKLLKDKNEFHKHMEFYFLIKGQFLRMSLVKHMELENMSSEVVVEIEYVKYTAPQPEQCMFHDDWILSVKGAKEWILTGSYDKTSQIRSLERKSIMTIVGHRDVLKDVAWAKKKDSLSCLFVSASMDPTILLWEWNREKQSESPTVLQRSCWKCRVYSC

SEQ ID NO: 325 - DNA, 549 bp, Homo sapiens
  CDS (1)...(549)
atggaggctgaaagactaagccagtctagtctgtccatgttcctctgcctgctttttattctatccgtgctggcagctgatgagatgatgcccacccagattgaggctactattaccttcttgcttgtcacgttgctcatttactcctcagggccagctaggtgcctggagtctcccctgaaagaactcaagattttcctttattttcatgctcagcgcgggggtgcggcagaggtccctgctctgtctcactgggactatcaagtgtctggtacagaaaatagagcaactcaatgcagttgccggtttcagagcattcttgaattgatcgtgaaacagctttccaggtgcgatcgtataaaggatcattggcagctgtgcagcttgtcagctagctgcagaaacccaggtgtcatgctgacagcttcagtgttaatagcctttcagacttggagagccagcatccgacataaaaatgatagtcttatagagtttgttaatcagctctcaacactgtgtaagaatagacccctggatcggcttctgtga

SEQ ID NO: 326 - protein, 182 aa, Homo sapiens
MEAERLSQSSLSMFLCLLFILSVLAADEMMPTQIEATITFLLVTLLIYSSGPARCLESPLKELKIFLYFHAQRGGAAEVPALSHWDYQVSGTENRATQCSCRFQSILELIVKQLSRCDRIKDHWQLCSLSASCRNPGVMLTASVLIAFQTWRASIRHKNDSLIEFVNQLSTLCKNRPLDRLL

SEQ ID NO: 327 - DNA, 681 bp, Homo sapiens
  CDS (1)...(681)
atggtgagttcttggggagggggagtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggcttgaacgagaggccgcccgacttgcagacctaggttga

SEQ ID NO: 328 - protein, 226 aa, Homo sapiens
MVSSWGGGVSYRHLGLLILALLALLTLLGVVLALTCRRPQSGPGPARPVLLLHAADSEAQRRLVGALAELLRAALGGGRDVIVDLWEGRHVARVGPLPWLWAARTRVAREQGTVLLLWSGADLRPVSGPDPRAAPLLALLHAAPRPLLLLAYFSRLCAKGDIPPPLRALPRYRLLRDLPRLLRALDARPFAEATSWGRLGARQRRQSRLELCSRLEREAARLADLG

SEQ ID NO: 329 - protein, 6 aa, Artificial Sequence
  peptide tag
EYMPME

We claim:

1. An isolated polynucleotide consisting of the nucleotide sequence SEQ ID NO: 1.

2. An expression vector comprising the following operably linked elements:
   a transcription promoter;
   a DNA segment encoding a polypeptide of SEQ ID NO: 2; and
   a transcription terminator.

3. A cultured cell comprising the expression vector of claim 2.

4. An isolated polynucleotide encoding a fusion protein, said protein comprising a secretory peptide from residue 1 to residue 21 g SEQ ID NO:2.

5. An expression vector comprising the following operably linked elements:
   a transcription promoter;
   a DNA segment encoding the fusion protein of claim 4; and
   a transcription terminator.

6. A cultured cell comprising the expression vector of claim 5, wherein the cell expresses the DNA segment and produces the encoded fusion protein.

* * * * *